United States Patent 9,073,990 (PROTEASE-ACTIVATABLE PORE-FORMING POLYPEPTIDES) - sequence listing, part 8

SEQ ID NO: 22441 - protein, 352 aa, Aeromonas hydrophila
MKKTILAIAIPALFASAANAAVIYDKDGTTFDVYGRVQANYYGDTNEADSTAASGYKDVDGELKGQSRLGWSGKVALNNTWSGIARTEWQVAAENSDSNKFQARHIYAGFDGSQYGKIIFGQTDTALYDVLEPTDIFNEWGSEGNFYDSRQEGQVIYSNAVGGFKGKVSYQTNDDTVEKITDVAGGIKTTVFPDVKRKYGYAAAAGYDFDFGLGFNAGYAYSDLEAKSTDATGEKSEWALGAHYAINGFNFAGVYTQADVKNDTSGRKDKGRGYELAATYNVDAWTFLAGYNFKEGKENSNLSGSSYEDLMDATLLGVQYSFTSKLKAYTEYKINGVSGKDDDWTVAMQYNF

SEQ ID NO: 22442 - protein, 388 aa, Neisseria meningitidis
MRKKLTALVLSALPLAAVADVSLYGEIKAGVEGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQLPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22443 - protein, 395 aa, Neisseria meningitidis
MRKKLTALVLSALPLAAVADVSLYGEIKAGVEGRNFQLQLTEPPSSNQGKNQAQTGNTVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYYTKDTNNNLTLVPAVVGKPGSDVYYAGLNYKNGGFAGNYAFKYARHANVGRNAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22444 - protein, 628 aa, Zymomonas mobilis
MKNNFKIAKVAQWVLALSIATTSAEAWADPLGNWLAKVNNHHKQKESASEQSVEQDDRTDTDNTVNTSPVANQPQAQTSQTVSQPSAVTPYQSVNNRESQAASQIPAADATDNDVRMSDNDNNDASGRSVDAPQMAEVSHQHVSPAPFPYASLTVGSSELQPETDPRLPVSKGGVVEENVENKGLVDSIVQSTRGRHNAFAWIGVGDNSVMLARDPKDRGMFGTWLGIKPWLRDKGIDIQSSMGGVETAFNARGGDRHALRTAYQWLVQASFDMERLGVVKGGKFNFMMTKRGGGQIEQAINSTTLTEMQEVYGRGNIWRLIEGSYEQQIGRFNIKVGRLTENNEFGMAMTGCSFMSLGFCGNQAGNLVGDYWYNWPVSNWAGRVTYQVSKEVTIGAGVFDVNRKNIQGKVLHENFYMDNPFHPEAGLYIGEVKWAPKFGRENNLEGLFKFDGWYTDDKSYNLRYYQDVAMQTGYSSQGPEVRGRYGAYVTAEQQVLRFDSHRQLTVAFRALKNDGRTNKSTAEVSAYAILFGVSKERPDDWVGLGAGTTWLSNAFLKSQALSAQNRHQEYYSELFYNIQLSPAVFLRPNIQYVVHPGGYYARGPVDTPYNYNSKNIILLGLKSGWVF

SEQ ID NO: 22445 - protein, 388 aa, Neisseria meningitidis
MKKALAILPFTALAFVPTCSAVDVFKDDKNVFQIGGYIDARVIDTQGVTEVVNGSSRINFAFTRDMSNDWTTYAKLEWGVNPFGNSTIAYSSESNFETKSGDFLNNRLGYVGLSHDAYGSITIGKQWGAWYDVVYNTNYGFVWDGNASGTYTYNKSDGAINGVGRGDKVIQYRNGFGDFSMAIQMQLKNSVSDIEDDGSNSPNRLVMTEYDNTYGIGLTYEATEMLTLTAGGNFGEPEGTTASGVVISETDYIYGVGASWGNWDSYGFYVAANVNANEFHDTDNIGRFLQEAIGLESIASYLFDNNVKILASYNILEAGDKYEAAHPGDVFKRQFAFAGVHYIWDNSVIFYLEGRVDFSDFSSSTPGLEARQALTEDDGIAVGVRYTL

SEQ ID NO: 22446 - protein, 369 aa, Neisseria meningitidis
MKKALAAAALLTFGVAAHAQSSVTLYGRLDAGLEYMSGVPTSATGSGTATSSTHRFRAESGDWGTSLWGLKGAEDLGGGYKAVFQLEGSFNTMTGAGPGGGGLFNRWATVGFASDQYGTFTMGRMLFISNGVWDFDPFGQSNWSSASLVRGRNWPQSSNNVAYQSPKIAGLDFYGQYALSNATNWNGNGTTAQGREAGAQVTYTSSLFQLRGIYDEIRNPANGGLNDSYNFSREYTAAFNVFLGQFKIQGAYQAIRTSGITAATPGTPTTLDHEWGGVTWQATPAAALIGAVYHVNGNNGAGNATIYTLGGSYNLSKRTLFDLQVATVQNSKTANYGLNANPAGNTVASDNPLIGHSQTGVYAGIQHSF

SEQ ID NO: 22447 - protein, 350 aa, Neisseria meningitidis
IKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYT

SEQ ID NO: 22448 - protein, 347 aa, Neisseria meningitidis
IKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGANTSYDQIIAGVDYDFSKRTSAIVSGAWLKRNTGIGNYT

SEQ ID NO: 22449 - protein, 349 aa, Neisseria meningitidis
IKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYT

SEQ ID NO: 22450 - protein, 350 aa, Neisseria meningitidis
IKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQPPTLVPAVVGKPGSDVYYAGLNYKNGGFAGNYAFKYAKHANVGRDAFELFLLGSGSDEAKGTDPLKNHQVHRLTGGYEEDGLNLALAAQLDLSENADKTKNSTTEIAATASYRFGNAVPRISYAHGFDFIERGKKGENTSYDQIIAGVDYDFSKRTSAIVSGAWLKRNTGIGNYT

SEQ ID NO: 22451 - protein, 350 aa, Neisseria meningitidis
IKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQPPTLVPAVVGKPGSDVYYAGLNYKNGGFAGNYAFKYAKHANVGRDAFELFLLGSGSDEAKGTDPLKNHQVHRLTGGYEEAGLNLALAAQLDLSENADKTKNSTTEIAATASYRFGNAVPRISYAHGFDFIERGKKGENTSYDQIIAGVDYDFSKRTSAIVSGAWLKRNTGIGNYT

SEQ ID NO: 22452 - protein, 346 aa, Neisseria meningitidis
IKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYT

SEQ ID NO: 22453 - protein, 566 aa, Neisseria meningitidis
  misc_feature (315)..(315): Xaa can be any naturally occurring amino acid
  misc_feature (421)..(421): Xaa can be any naturally occurring amino acid
  misc_feature (541)..(541): Xaa can be any naturally occurring amino acid
  misc_feature (543)..(543): Xaa can be any naturally occurring amino acid
IINKGATVTAQGKMYVDKAIELAGTLTLTGTPTENNKYSPAIYMSDGYNMTEDGATLKAQNYAWVNGNIKSDKKASILFGVDQYKEDNLDKTTHTPLATGLLGGFDTSYTGGIDAPAASASMYNTLWRVNGQSALQSLKTRDSLLLFSNIENSGFHTVTVNTLDATNTAVIMRADLSQSVNQSDKLIVKNQLTGSNNSLSVDIQKVGNNNSGLNVDLITAPKGSNKEIFKASTQAIGFSNISPVISTKEDQEHTTWTLTGYKVAENTASSGAAKSYMSGNYKAFLTEVNNLNKRMGDLRDTNGEAGAWARIMSGXSSASGGYSDNYTHVQIGVDKKHELDGLDLFTGLTMTYTDSHASSNAFSGKTKSVGAGLYASAIFDSGAYIDLISKYVHHDNEYSATFAGLGTKDYSSHSLYVGAEXATAIMLTKDPGLSRRQNWFMGPVSGKRFDWQDRGMSVTMKDKDFNPLIGRTGVDVGKSFSGKDWKVTARAGLGYQFDLFANGETVLRDASGEKRIKGEKDGRILMNVGLNAEIRDNLRFXLXFEKSAFGKYNVDNAINANFRYSF

SEQ ID NO: 22454 - protein, 342 aa, Neisseria meningitidis
IKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYT

SEQ ID NO: 22455 - protein, 392 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKNTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22456 - protein, 386 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPEFSGFSGSVQFVPAQNSKSAYTPAHFVQQTPQSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22457 - protein, 979 aa, Xanthobacter autotrophicus
MLALMLCASAGGAWAQSAAPQKTDEERARAEQAAIDTAGEAAVVDSVEVTGSRLGSGDPTSRVIVISKEEIQARGVTSVEQLIRTLPQNVATIGAVTNERARGPLSNRGQVGVSQIGSLGVSAANLGGMGAGNTLILINGRRVAGAAGIEDGFANLNGIPLSAVERVEISFGGASAVYGADAIGGVINFILRKDFVGSTLTVQHEVSSNDADNSRISLFSGYSWGSGNISGTLDFSRRKPVNNHKSGYVTENYSSYYGGDTAFDTRSFSRGLQPGVIDRSFYRFDPVTFESGYVSQGLTVRPGFVGRPGLNDFITVGAEALPDYVPEFAGPESESTSATLNFEQKITDKLTFFGDALYTRSKSEQDILYAEGLEVQLAPGQAYNPFPANPFDRFTPGPIVAYNPQAEVEAGQLPAGRISNTATQWNINAGLSYQFNADTKIELLYSRSEADTSGQSPNLGSIVDFKADATSPSGVKCYNRDLAENRVTGADRDYLQGVFDRQCLALTSSDPTLAFNPWKSTADGGGSNVADFYYIPVTEARASGTQNWEARMNGVLWTLPAGKLFYAVGAEMTVDDTDSKEVRIRTINPVTRDRHAYFAELRVPIFGENFNYTGARSLLLSLAARRDSYTTEGPIGTVNNVPYSMGGELLYDSNTFANTTPAVGLRWEPFEGLALRARWTEGFQAPPYTQLFNPLGTQRTTTTISDDPLYKCTTDCSRPGTYVVPRVVAPNPDLEPQKSTQVSYGLTWRPKGMLDGLTFDVAYNSTKIDSEYANQNDLQTFLRRDEILRLTQFYPRDANGKIIEARQMTFNIVGSEYESINYELSYLWNTNWGTFEPKINVLDNIKAERQAFPDREPLSALGLLQGPDDYKVVGSLGWYYHDFNASLWAYYTPEYTNDYEIFRSAGVNMYENRLIPVDDMLIMDLTAAWRINNDIRLNFAGRNILDEAPPFVVVQGRPYDTARYNAAGRTFSLELQYSF

SEQ ID NO: 22458 - protein, 673 aa, Escherichia coli
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSLSDGSPDPYMRRCTDSQTLSGKYTTDDWVFNLISAWQQQHYSRTYPVGTLLVNLPQRWNQDVQELRAATLGDARTVDMVFGLYRQNTREQMQATYDMPTMRYLTSAGYTTAETLAAYSDLTWHLTDRFDIGGGVRFSHDKASTQYHGNLAGNPFGDDGKSDDDQVLGQLSAGYMLTDDWRVYTRVAQGYKPSGYNIIPTAGLSAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 22459 - protein, 378 aa, Pasteurella haemolytica
MKKTLVALAVLSAAAVAQAAPQANTFYAGAKAGWASFHDGLTQFDNTYDYGSGINLGINLGINRNSVTYGVFGGYQILNQNNFGLATELGYDYFGRVRGNTTFSGDDKEKTAAKHSAHGAHLSLKPSYEVVPNLDVYGKVGVALVRNDYYVQQHVDKDSRIKVHNLKPSLLLGAGLEYAITPELAARVEYQYLNRVGNLDKAVRTTVGYLIPRGTNFQYSPDIHSVSAGLSYRFGQGAAPVEAPEVVTKNFAFSSDVLFDFGKSSLKPAAATSLDAAHAEISNLGLANLAIQVNGYTDRIGKEASNLKLSQRRAETVANYIVSKGINPANVTAVGYGEANPVTGHTCDAVKGRKALIACLAPDRRVEIQVQGSKEVTM

SEQ ID NO: 22460 - protein, 870 aa, Zymomonas mobilis
MMGKSSLLATAGVVALTAAFAAAQEEDVVVVTATKREQTLQEVPVAVSVVQEDFLQQTQVEDITDLEDIVPSLRVSQLERSNNVTFIIRGFGNGGNNAGIEPSVAVYVDGVFRSRAGSSLGDFLNLERVEVLRGPQSTLFGKNATAGVVSFVTKKPSFEPEGVGEVTVGNFGSRIAKAYISGPITDNMAFSLAGNVNQREGYTDNLAGGADINDRDRFGLRGELLFEPTDRVEIRLQGDYDALDEICCTVFNAGETPLIGGTTITSGDVIRAIGGEKQEPGAFDYDVYYDTDSVNDIKNGGVAAITEVEVTPAVTLTSISAFRTSDQFISFEGDFTSAEILRDNTRDLSTETFTQELRFEGSHGIVDWLVGGFYFNEDLTEDTLITLGDDTRAFADVVAADTSVPGGPSFIDQVETAAGFDQGTLLAAGDGIRFRAEQDNTQYSFFAQADIAVTDRLTLTLGASYYNDEKEVSLQGVSDNPFGALDFTDPAIASDVTLRALVAGLQGLVDGNGNPRVASPAEVAAFQTANPLGFALVNSLVPASVGLAAVNPLLQLTTLQAGTIAPFVNLPNDIENNKTEDDDVPYTIRASYDLSNRTSVYASFATGFKASSWNLTPDSRPFSTDIAALDAAGLLPSTTRVARGQYAGTRFAGPEETKTFEAGLKTRWGWGSLNVAIFDQDVEGFQSQTFQGAGFVLTNAGSQSTFGVELESVIEPFEGLTINWAGTYLDAKFDQFENAPVPVTPETPDGVGDLSGERVPGVPEFSSYLGVRYGVPTGWGEVFARTGWRYESEVQVISNVPEDVASREVSVLDAGIGVIADNGFEALLWGKNLFEDEFYTSAFPTTFQPGAFSAYPNEPRTYGITLRKRF

SEQ ID NO: 22461 - protein, 344 aa, Neisseria gonorrhoeae
MKKSLIALTLAALPVAATADVTLYGAIKAGVQTYRSVEHREGKVVGVETGSEISDFGSKIGFKGQEDLGNGLKAVWQLEQGASVAGTNTGWGNKQSFVGLKGGFGTIRAGSLNSPLKNTGDNVNAWESGKFTGNVLEISGMAKREHRYLSVRYDSPEFAGFSGSVQYAPKDNSGSNGESYHVGLNYQNSGFFAQYAGLFQRYGEGTKKMEVYNIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQRGKGADKIVSTASAVVLRHKF

SEQ ID NO: 22462 - protein, 348 aa, Neisseria gonorrhoeae
MKKSLIALTLAALPVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 22463 - protein, 327 aa, Neisseria gonorrhoeae
MKKSLIALTLAALPVAATADVTLYGTIKAGVQTYRSVEHTKGKVSKVETGSEIADFGSKIGFKGQEDLGNGLKAVWQLEQGASVAGTNTGWGNKQSFVGLKGGFGKVRVGRLNSVLKDTGGFNPWEGKSDYLSLSNIAEPEARHISVRYDSPEFAGFSGSVQYELNDNSNKYNSESYHAGFNYKNSGFFVQYAGAYKRHHYATEKHQVHRLVGGYDHDALYASVAVQQQDAKLALIDDNSHNSQTEVAATVAYRFGNVTPRVSYAHGFKGLVYHADLSNDYDQVVVGAEYDFSKRTSALVSAGWLQEGKGAEKFVSTAGVVGLRHKF

SEQ ID NO: 22464 - protein, 348 aa, Neisseria gonorrhoeae
MKKSLIALTLAALPVAATADVTLYGAIKAGVQTYRSVAHREGKVVGVETGSEISDFGSKIGFKGQEDLGNGLKAVWQLEQGASVAGTNTGWGNKQSFVGLKGGFGTIRVGSLNSPLKNTGANVNAWESGKYTGTFLEISKMAGREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVSTASAVVLRHKF

SEQ ID NO: 22465 - protein, 348 aa, Neisseria gonorrhoeae
MKKSLIALTLAALPVAATADVTLYGAIKAGVQTYRSVEHRKGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQSYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVSTASAVVLRHKF

SEQ ID NO: 22466 - protein, 260 aa, Neisseria meningitidis
MNPAPKKPSLLFSSLLFSSLLFSSAAQAASEDGSRSPYYVQADLAYAAERITHNYPEPTGADKDKISTVSDYFRNIRAHSIHPRVSVGYDFGGWRIAADYASYRKWKESNSSTNTENSETQQNRIKIETGHQGNGSFHAASSLGLSAIYDFKLNDKFKPYIGARVAYGYVKHQVHSVESKTKTVTPKPNGGPVKEGPTPKPAYHESHSISSVGLGVIAGVGFDITPKLTLDTGYRYHNWGRLENTRFKTHEVSLGMRYRF

SEQ ID NO: 22467 - protein, 333 aa, Klebsiella granulomatis
LMMMGFVASTATQAAEVYNKNANKLDVYGKIKAMHYFSDYDSKDGDQTYVRFGIKGETQINDDLTGYGRWESEFCGNKTESDSSQKTRLAFAGVKLKNYGSFDYGRNLGALYDVEAWTDMFPEFGGDSSAQTDNFMTKRASGLATYRNTDFFGLVDGLDLTLQYQGKNEGREAKKQNGDGVGTSLSYDFGGSDFAVSAAYTSSDRTNDQNLLARGQGSKAEAWATGLKYDANNIYLATMYSETRKMTPISGGFANKAQNFEAVAQYQFDFGLRPSLGYVLSKGKDIEGVGSEDLVNYIDVGLTYYFNKNMNAFVDYKINQLKSDNKLGINDDD

SEQ ID NO: 22468 - protein, 219 aa, Neisseria meningitidis
EFSGFSGSVQFVPAQNSKSAYKPAYWTTVNTGSATTTTTTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAA

SEQ ID NO: 22469 - protein, 348 aa, Neisseria gonorrhoeae
MKKSLIALTLAALPVAAMADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQTYSIPSLFVEKLQVHRLVGGYDNNALYVSVAAQQQDAKLYGAMSGNSHNSQTEVAATAAYRFGNVTPRVSYAHGFKGTVDSANHDNTYDQVVVGAEYDFSKRTSALVSAGWLQGGKGADKIVSTASAVVLRHKF

SEQ ID NO: 22470 - protein, 348 aa, Neisseria gonorrhoeae
MKKSLIALTLAALPVAATADVTLYGAIKAGVQTYRSVEHREGKVVGVETGSEISDFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEYDFSKRTSALVSAGWLQEGKGADKIVSTASAVVLRHKF

SEQ ID NO: 22471 - protein, 348 aa, Neisseria gonorrhoeae
MKKSLIALTLAALPVAATADVTLYGAIKAGVQTYRSVEHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYNSQSYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVSTASAVVLRHKF

SEQ ID NO: 22472 - protein, 667 aa, Helicobacter pylori
MKKTLLLSLSLASSLLNAEDNGFFISAGYQIGEAAQMVTNTGELKKLSDTHENLSNLLNNFNHLNQAVKNASSPSEINAAIDNLKANTQGLTGEKTNSPAYQAVYLALNAAVGLWNVIAYNVQCGPGNSGQQSVTFDGQPGHNSSSINCNLTGYNNGVSGPLSIENFKTLNQAYQTIQQALKQDSGFPVLDNKGKQVTITITTQTNGQSSKETTTTTNNAQNLLQEASKMIGVLTTNCPWVNHNQGQNGGAPWGLNTAGNVCQVFATEFSAVTSMIKNAQEIVTQAQSLNANQNNQNAPQDFNPYTSSDRAFAQNMLNHAQAQAKMLELADQMKKDLNTIPSQFITNYLAACRNGGGTLPNEGVTSNTWGAGCAYVEETITTLNNSLAHFGTQAEQIKQSELLARTILDFRGSLSTLNNTYNSITTTASNTPNSPFLKNLISQSTNPNNPGGLQAVYQVNQSTYSQLLSATQELGHNPFRRVGLISSQTNNGAMNGIGVQVGYKQFFGEKRRWGLRYYGFFDYNHAYIKSSFFNSASDVFTYGVGTDVLYNFINDKATKNNKISFGVFGGIALAGTSWLNSQYVNLATFNNFYSAKMNVANFQFLFNLGLRMNLAKNKKKASDHVAQHGVELGVKIPTINTNYYSLLGTQLEYRRLYSVYLNYVFAY

SEQ ID NO: 22473 - protein, 900 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVHTNGIAHRTELRGTRAELGLGMAAALGRGHSLYASYEYSKGPKLAMPWTFHAGYRYSW

SEQ ID NO: 22474 - protein, 384 aa, Neisseria meningitidis
MRKKLTALVLSALPLAAVADVSLYGEIKAGVEGRNFQLQLTEPLSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTGQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLR

SEQ ID NO: 22475 - protein, 389 aa, Neisseria meningitidis
MRKKLTALVLSALPLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLR

SEQ ID NO: 22476 - protein, 387 aa, Neisseria meningitidis
MRKKLTALVLSALPLAAVADVSLYGEIKAGVEGNNIQLQLTEPPSKGQTGNKVTKGKSRIRTKINDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPATYTVDSSNVVTPVPAVVGKPGSDVYYAGLNYKNGGFAGNYAFKYAKHANVGRDAFNLFLLGRIGEDDEAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAASVGLRHK

SEQ ID NO: 22477 - protein, 386 aa, Neisseria meningitidis
MRKKLTALVLSALPLAAVADVSLYGEIKAGVEGRNIQLQLTEPLQNIKQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVKNKQNQRPTLVPAVVGKPGSDVYYAGLNYKNGGFAGNYAFKYAKHANVGRDAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLR

SEQ ID NO: 22478 - protein, 386 aa, Neisseria meningitidis
MRKKLTALVLSALPLAAVADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHYTTVYNATTTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRH

SEQ ID NO: 22479 - protein, 384 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNVVPRISYAHGFDFIERGKKGENTSYDQIIAGVDYDFSKRTSAIVSWRWLKRNTGIGNYTQINAA

SEQ ID NO: 22480 - protein, 388 aa, Neisseria meningitidis
MRKKLTALVLSALPLAAVADVSLYGEIKAGVEGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQRPTLVPAVVGKPGSDVYYAGLNYKNGGFAGNYAFKYAKHANVGRDAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22481 - protein, 385 aa, Neisseria meningitidis
MRKKLTALVLSALPLAAVADVSLYGEIKAGVEGNNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMPVSVRYDSPEVSGFSGSVQFVPAQNSKSAYTPAHFVQQTPQSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22482 - protein, 385 aa, Neisseria meningitidis
MRKKLTALVLSALPLAAVADVSLYGEIKAGVEGNNIQLQLTEPPSKSQTGNKVTKGKSRIRTKINDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVVKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22483 - protein, 386 aa, Neisseria meningitidis
MRKKLTALVLSALPLAAVADVSLYGEIKAGVEGRNIQLQLTEQPSKAQGQTNNQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVDEKQVSHAAVVGKPGSDVYYAGLNYKNGGFAGSYAFKYAKHANEGRDAFFLFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22484 - protein, 380 aa, Neisseria meningitidis
MRKKLTALVLSALPLAAVADVSLYGEIKAGVEGNNIQLQLTEPPSKGQTGNKVTKGKSRIRTKISDFGSFIGFKGSEDLGEGLKAVWQLEQDVSVAGGGASQWGNRESFIGLAGEFGTLRAGRVANQFDDASQAIDSWDSNNDVASQLGIFKRHDDMPVSVRYDSPEFSGFSGSVQFVPIQNSKSAYTPAHVVVNNNVATHVPAVVGKPGSDVYYAGLNYKNGGFAGNYAFKYARHANVGRNAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 22485 - protein, 388 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22486 - protein, 380 aa, Neisseria meningitidis
MRKKLTALVLSALPLAAVADVSLYGEIKAGVEGNNIQLQLTEPPSKGQTGNKVTKGKSRIRTKINDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPATYTVDSSGVVTPVPAVVGKPGSDVYYAGLNYKNGGFAGNYAFKYAKHANVGRDAFNLFLLGRIGEDDEAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAA

SEQ ID NO: 22487 - protein, 393 aa, Neisseria meningitidis
MRKKLTALVLSALPLAAVADVSLYGEIKAGVEGRNIQAQLTEQPQVTNGVQGNQVKVTKAKSRIRTKISDFGSFIGFKGSEDLGEGLKAVWQLEQDVSVAGGGASQWGNRESFIGLAGEFGTLRAGRVANQFDDASQAINPWDSNNDVASQLGIFKRHDDMPVSVRYDSPEFSGFSGSVQFVPAQNSKSAYKPAYYTKDTNNNLTLVPAVVGKPGSDVYYAGLNYKNGGFAGNYAFKYARHANVGRNAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22488 - protein, 321 aa, Pseudomonas fluorescens
MKLKNTLGLAIGSLIAATSFGVLAQGQGAVEGELFYKKQYNDSVKHIEDGFNPGARIGYFLTDDLSLNLSYDKTNHTRSNDGTGNQKIKGDTGSLVAQYHFGQAGVDSLRPYVEGGFGHQSRTNVQADGHSGRDQTTFATVGTGVKYYFTNNLYARAGVEADYGLDNGKWDYSALVGLGVNFGGNAGAAAPAPTPAPAPEPTPEPEAPVAQVVRVELDVKFDFDKAVVKPNSYGDVKNLADFMAQYPATNVEVAGHTDSVGPDAYNQKLSQRRADAVKQVLVKDGVAPSRVTAVGYGESRPVADNATEAGRAVNRRVEAAV

SEQ ID NO: 22489 - protein, 388 aa, Neisseria meningitidis
MRKKLTALVLSALPLAAVADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRDAFNLFLLGRIGDDDEAKGTDPLKNHQVHRLTSGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22490 - protein, 93 aa, Neisseria meningitidis
MRKKLTALVLSALPLAAVADVSLYGEIKAGVEGRNYQLQLTEKPSSTKAKTGNKVEVTKAKSRIRTRISDFGSFIGFKGSEDLGDGLKAVWQL

SEQ ID NO: 22491 - protein, 296 aa, Neisseria meningitidis
MRKKLTALVLSALPLAAVADVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTFVPAVVGKPGSDVYYAGLNYKNGGFAGNYAFKYARHANVGRDAFELFLLGSGSDQAKGTDPLKNHQVHRLTGGYEEGGLNLALAAQLDLS

SEQ ID NO: 22492 - protein, 376 aa, Neisseria meningitidis
MRKKLTALVLSALPLAAVADVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVRSQLGIFKRHDDMPVSVRYDSPDFSGFSGSVQFVPIQNSKSAYTPAHVVGKPGSDVYYAGLNYKNGGFAGNYAFKYARHANVGRNAFELFLIGSATSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22493 - protein, 388 aa, Neisseria meningitidis
MRKKLTALVLSALPLAAVADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATVANGANNTIIRVPAVVGKPGSDVYYAGLNYKNGGFAGNYAFKYARHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22494 - protein, 386 aa, Neisseria meningitidis
MRKKLTALVLSALPLAAVADVSLYGEIKAGVEGNNIQLQLTEQPSKGQVGNKVTKGKSRIRTKINDFGSFIGFKGSEDLGDGLKAVWQLEQDVSVAGGGATRWGNRESFIGLAGEFGTLRAGRVANQFDDASQAIDPWDSNNDVRSQLGIFKRHDDMPVSVRYDSPDFSGFSGSVQFVPIQNSKSAYTPAHVVVNNKVATHVPAVVGKPGSDVYYAGLNYKNGGFAGNYAFKYARHANVGRNAFELFLIGSATSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22495 - protein, 346 aa, Aggregatibacter actinomycetemcomitans
MKRTAIALAIAGLAAATVAQAAPQANTFYAGAKAGWASSHHGLNQFKQKGVSINRNSEAYGVFGGYQITDNFAVEAGYEYFGRSKAKVNGAQRFRHTAHGTTLALKASYPVLDNLDVYGRVGAALIRSDYKVGQANKPDRYHNLKVSPVFAGGVEYAILPELALRAEYQWVSRVGNLGRAEEKADRSARTIDYSPDIGSVAVGLSYRFGQGVAPAPAPEVVRKTFSLNSDVTFAFGKANLKPQAQNTLDGIYGEIAQVNNANVQVAGYTDRIGSDAYNQKLSQRRAETVANYLVSKGVSQQAISATGHGKANPVTGNKCDAVKGRKALIACLADDRRVEIAVNGTK

SEQ ID NO: 22496 - protein, 344 aa, Pseudomonas fluorescens
MKLKNTLGFAIGSLIAATSFGALAQGQGAVEIEGFAKKEQFDSARNFKNNGNLFGGSVGYFLTDDVELRLAYDEVHNARTDDGTNVKGANTALDALYHFNNPGDMLRPYVSAGFSDQSIDQNGSNGRNRSTFANVGGGAKLYFTENFYARAGVEAQYNIDQGDTEWAPSVGIGVNFGGGSKPAAAPVPAPAEVCSDSDNDGVCDNVDKCPDTPANVTVDADGCPAVAEVVRVELDVKFDFDKSVVKENSYGDIKNLADFMKQYPSTSTTVEGHTDSVGPDAYNQKLSERRANAVKQVLTNQYGVESSRVQSVGYGESRPVADNATDAGRAVNRRVEAQVEAQAK

SEQ ID NO: 22497 - protein, 392 aa, Neisseria meningitidis
MRKKLTALVLSALPLAAVADVSLYGEIKAGVEGRNYQLQLTEQPSNTNGKTGNKVEVTKAKSRIRTRISDFGSFIGFKGSEDLGEGLKAVWQLEQDVSVAGGGATRWGNRESFVGLAGEFGTLRAGRVANQFDDASQAIDPWDSNNDVASQLGIFKRHDDMPVSVRYDSPDFSGFSGSVQFVPAQNSKSAYTPAYYTTVTQGSATTTTFVPAVVGKPGSDVYYAGLNYKNGGFAGNYAFKYARHANVGRDAFELFLLGSGSDQAKGTDPLKNHQVHRLTGGYEESGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHK

SEQ ID NO: 22498 - protein, 382 aa, Neisseria meningitidis
MRKKLTALVLSALPLAAVADVSLYGEIKAGVEGRNYQLQLTEAQAANGGAGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAA

SEQ ID NO: 22499 - protein, 386 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAKDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22500 - protein, 386 aa, Neisseria meningitidis
MRKKLTALVLSALPLAAVADVSLYGEIKAGVEGNNIQLQLTEPPSKGQTGNKVIKGKSRIRTKINDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPATYTVGSRDVVTPVPAVVGKPGSDVYYAGLNYKNGGFAGNYAFKYAKHANVGRDAFNLFLLGRIGEDDEAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAASVGLRH

SEQ ID NO: 22501 - protein, 382 aa, Neisseria meningitidis
MRKKLTALVLSALPLAAVADVSLYGEIKAGVEGRNYQLQLTEKPSSTNAKTGNKVEVTKAKSRIRTRISDFGSFIGFKGSEDLGDGLKAVWWLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQI

SEQ ID NO: 22502 - protein, 374 aa, Neisseria meningitidis
MRKKLTALVLSALPLAAVADVSLYGEIKAGVEGNNIQLQLTEQPSKGQVGNKVTKGKSRIRTKINDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPAQNSKSAYTPAYVDEQSKYHAAVVGKPGSDVYYAGLNYKNGGFAGNYAFKYARHANVGRDAFELFLLGSGSDQAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAA

SEQ ID NO: 22503 - protein, 389 aa, Neisseria meningitidis
MRKKLTALVLSALPLAAVADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHYTTVYNATTTTTTTFVPAVVGKPGSDVYYAGLNYKNGGFAGNYAFKYAKHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22504 - protein, 386 aa, Neisseria meningitidis
MRKKLTALVLSALPLAAVADVSLYGEIKAGVEGRNYQLQLTEAQSANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAKDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22505 - protein, 311 aa, Neisseria meningitidis
MRKKLTALVLSALPLAAVADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAHVVVNNNVATHVPAVVGKPGSDVYYAGLNYKNGGFAGNYAFKYARHANVGRNAFELFLIGSATSDEAKGTDPLKNHQVHRLTGGYEEGGLNLALAAQLDLSENADKTKNSTTE

SEQ ID NO: 22506 - protein, 86 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVW

SEQ ID NO: 22507 - protein, 910 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGFGPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVHTNGIAHRTELRGTRAELGLGMAAALGRGHSLYASYEYSKGPKLAMPWTFHAGYRYSW

SEQ ID NO: 22508 - protein, 905 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVHTNGIAHRTELRGTRAELGLGMAAALGRGHSLYASYEYSKGPKLAMPWTFHAGYRYSW

SEQ ID NO: 22509 - protein, 910 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGAVPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVHTNGIAHRTELRGTRAELGLGMAAALGRGHSLYASYEYSKGPKLAMPWTFHAGYRYSW

SEQ ID NO: 22510 - protein, 344 aa, Pseudomonas marginalis
MKLKNTLGLAIGSLIAATSFGALAQGQGAVEIEGFAKKEQFDSARNFKNNGNLFGGSIGYFLTDDVELRLGYDEVHNVRADDGKNVKGANTALDALYHFNNPGDMLRPYVSAGFSDQSIDQNGSNGRNRSTFANLGAGAKLYFTDNFYARAGVEAQYNIDQGDTEWAPSVGIGVNFGGGSKPAAAPVPAPAEVCSDSDNDGVCDNVDKCPDTPANVTVDADGCPAVAEVVRVELDVKFDFDKSVVKPNSYGDIKNLADFMKQYPSTTTTVEGHTDSVGPDAYNQKLSERRANAVKQVLTNQYGVESSRVQSIGYGESRPVADNKTEAGRAVNRRVEAQVEAQAK

SEQ ID NO: 22511 - protein, 344 aa, Pseudomonas putida
MKLKNTLGLAIGSLVAATSIGAMAQGQGAVETEVFYKKEFFDSQRDFKNDGNLFGGSIGYFLTDDVELRLGYDEVHNARGEDGKNIKGSNTALDAVYHFNNPYDAIRPYVSAGFSHQSLGQTGRGGRDHSTFANVGAGAKWYITDMFYARAGVEAQYNIDQGDTEWAPSVGVGLNFGGSPKQAEAAPAPVAEVCSDSDNDGVCDNVDKCPDTPANVTVDADGCPAVAEVVRVELDVKFDFDKSVVKPNSYGDIKNLADFMKQYPQTTTVVEGHTDSVGPDAYNQKLSERRANAVKQVLTQQYGVESSRVDSVGYGETRPVADNATEEGRAINRRVEAQVEAQSK

SEQ ID NO: 22512 - protein, 394 aa, Pseudomonas putida
MIKKSVVLGLVSIGSIGAHAQSSVTLYGVVDAGLAYTNNQGGASNIQQTSGKLSGSRWGLKGVEDLGDGLQAVFTLESGFRPSDGGLGQGGRLFGRSAYVGLNKTGLGTLTFGRQYEPITDLVAPYSGSGFWSPATHIGDNDNLNQSFRINNAVKFRSATIAGFTADALYAFSNQANGGAGTGFSNNNAWGVAANYVNGPFSAGAGYVRLNHPNATSNTSGAVGGATTTTGNDYSGAFFYGLNGGVRKQQIGVAGANYALGRATLGFAWSHTQLDYVDGSSRKFNNYDVNGRYQITPAATLIGVYTFTDGRASGLPGTGGQTLKPRWHQFTLGFDYALSKRTDIYLSGIYQLAAGDASTASSGGYRKIAAISNIGSASSTNRQVAFVSGLRVKF

SEQ ID NO: 22513 - protein, 822 aa, Pseudomonas putida
MSISLHKILFGAAPLSLGLLGLALPAELLAADETLGTVVVTGVRGSQQRTVTDSPAPIDVIDSEQLRSIGQNGLKEMLGRLLPSFNVPTINGGGTAFLVRGVSMRGLGGDQVLVLINGKRRHNSALINNGARVGNASVPVDLDLIPTAAIERIEVLRDGAAAQYGSDAIAGVINIILKRNAEGLTSDTTLGQYYDGDGTTGHEAFNWGNKLGENGGFINLSWDAKLQEPYERSSAASGQLYFKQADGSPDPRESNRQGWGTEYGLGRDRTTSLAYNAELPLEDDLKLYSFSTLSYRNSNKDLGHRKPTDITSLAGIPNAPYPNGGQARREIHETDFQVAGGAKGLLGGWDWDLSSTYGKDRGVLDTANNLNISNGPYSQHDFHLGNLVFDQWTNNLDFSRALDIGWSSPLETSFGVEYRWEKYALEEGEPNSYNQGSYVPNTGPFAGVVPDPGLFSVNGTTPEDAYSLKRHSEAAYIDLGLNITPNWYVGAAARYEKYNLGVGDTTSGKLTTRYEFLPGYAVRAAVSNGFRAPSLAQSVFSTTSTVTEFGAGGTTTSVRTKQMRPNSPEAVALGAKDLEPETSRNYSLGFTAEPTDRLRLTADFYLIDIDKRILQTGILKGPAVSQILVENGLSPNLAGQYYTNAADTRTKGVDLVADYRQSFGEYGTAKWSVAYNHNKTTIRDLADTPAALSRLGAGYVLFDRQQQIDLTKSTPKDKWILSGNYKVGDWTTNLQLTRFGEYTEGSNIPSNDRTYSAKWITDLDVAYDVTQNLTVAVGANNLFDVYPDKIGLKAWAGTYEYGMFSPYGLGGGYYYSRVSLAF

SEQ ID NO: 22514 - protein, 994 aa, Acidiphilium sp. AIU 409
MRKTNPAWWAAGFCLFAPLATPAAAGHLFTQSSSNKPTWISEGKGILIQQYGTESAWSSGGNIEMYFEQPPTVPEGADTSSANWWQWSVGDVMKITIPTDADTVILTIGYDTAGTDGCAYSYCGITGSSFFSFGGITALQNLSLKDHSGQRYDGNYTESDVYFPWSIQSLAGEFSLGGYRIYTSDGTINGTGSGPLDQNSVIDEDDIDVGGGGPKPITGDDNYDTDLGTDLAYVFDGGTLNSSTEVGSDFTLTGNGGTIRVAEGDQASFTGVIADDDPAAPGRLTKTGDGRLELTGTNSYSGGTSVTGGTLAIASDTALGAAEGDLTLDGGTLETTADVTSGRDIQLGAAGGTLDVTAGHETVLAGTVADAADGTPGALTKTGDGRLELTGTNSYSGGTSVTGGTLAIASDAALGAAEGDLTLDGGTLETTADVTSGRDIQLGAAGGTLDVTAGHETVLAGTVADAADGTPGALTKTGDGRLELTGTNSYSGGTSVTGGTLAIASDAALGAAEGDLTLDGGTLEATGNMTLARTLLVGEAGGTLEVGGSRTVRATGILAGSGDLAKTGSGSFLFSGMGLHTGALSILEGTFGTSGILLADSISVASGARLDASNRVAADIEVAGTLAVNEAVSTLTLTRNMTLQENATLELDIDGRAFSTEGGAGSYDRIDVVGLDAVFSAAGRLVPMLRNIAGAATNSFTALIGDSFRIVTTANENGISGAFSEIVTPAEGLAANSRFAVVYGSDYIDLVVTADSFELLAMPFGNRNATATGAAVDMMRDGDPGFDSTELLYGLYGLDTAQTARALAQLSGEIHAFALSDLRKADRVAAERLTAGAQGLRPDGRNAWVDVSGLSFEADGSAQASGNSSDSTLVWLGLDLLRTGNATLGLALGQSEGDLDAGLSGDASRTTDSLALYGFGLAGRLSYDVSLMASRSDIEGDRTVTLGTGVQSNSFDAEMTSIQASGRIGYRMDFPDQTAVMPWIGAEVNWMRAA

SEQ ID NO: 22515 - protein, 362 aa, Campylobacter jejuni
ASSQDESKGFVEDSKLNVKMRNLYFSRDYRNTESAGNKLAGLRHDQREWGQGFIGTFESGFTQGTVGVGVDAIGLLGIKLDSGRGYSGTGLFPTGSDQRSQDDYSKGGAAVKFRISDTVLKVGDQFTALPVFATDDSRLLPETAQGALLTSNEIKGLTLHAGRFKSMRAQAETDRDSISDGLGRRGLKEADVFGGSYAFTDSLSTSLYYSKVEDYWRKYYANVNWALPISDKQGLVFDFNIYDTKGEGDNLYRATADGDKLDNRAYSFSGAYNIGAHTFTLAYQKVTGDGEYAYGIDGGGSIFLANSVARSDFNAEGEKSWQVRYDLNFAEFGVPGLTFMTRYVRGTGAHTADTNDGKEWER

SEQ ID NO: 22516 - protein, 287 aa, Campylobacter jejuni
ASVLFGADNNVKFEITPTLNYNYFEGNLDMDNRYAPGVRLGYHFDDFWLDQLEFGLEHYSDVKYTNTNKTTDITRTYLSAIKGIDVGEKFYFYGLAGGGYEDFSNAAYDNKSGGFGHYGTGVKFCLSDSLALRLETRDQINFNHANHNWVSTLGISFGFGGKKEKAVEEVADTRPAPQAKCPVEPREGALLDENGCEKTISLEGHFGFDKTTINPTFQEKIKEIAKVLDENERYDTILEGHTDNIGSRAYNQKLSERRAKSVANELEKYGVEKSRIKTVGYGQDNPR

SEQ ID NO: 22517 - protein, 326 aa, Pseudomonas fluorescens
MKLKNTLGFAIGSIIAATSFGALAQGQGAVEGELFYKKQYNDSVKHIEDGFNPGARIGYFLTDDLSLNLSYDKTNHTRSNDGTGSQKIGGDTSSLTAQYHFGQAGVDSLRPYVEGGFGHQSRGNVKADGHSGRDQSTLAIAGAGVKYYFTNNVYARAGVEADYALDNGKWDYSALVGLGVNFGGNAGAAAPAPTPAPAPEPTPEPEAPVAQVVRVELDVKFDFDKSVVKPNSYGDVKNLADFMAQYPATNVEVAGHTDSIGPDAYNQKLSQRRADRVKQVLVKDGVAPSRITAVGYGESRPVADNATEAGRAVNRRVEASVEAQAQ

SEQ ID NO: 22518 - protein, 326 aa, Pseudomonas agarici
MKLKNTLGIAVGTLVAATSFGALAQGQGAVEGEVFYKKQYNDSVKHVEDGYNPGASLGYFITDDVSVNLTYDKTNYTRSNDGTGSQKLGGDKFGLKGQYHFGTVGDAIRPYVEGGVAHGSLTNVAADGHTGRDQSTFLTTGAGAKWYLTDNLYARAGVEADYKLDNGKWDYAALVGLGVNFGGSGGKVAPAPAPAPVAQEPAPAPEAPVAEVVKVELDVKFDFNKAVVKPNSYGDVKNLADFMKQYPQTTTVVSGHTDSVGTDAYNQKLSQRRADAVKQVLVKDGIAPNRIQSVVYGKTRPVADNATEAGRAINRRVEASVEAQAK

SEQ ID NO: 22519 - protein, 325 aa, Pseudomonas chlororaphis
MKLKNTLGIAIGSIVAVTSFGVLAQGQGAVEGELFYKKQYNDSVKHIEDGFNPGARIGYFLTDDLSLDLNYDKTNHTRSNDGTGNQKIKGDTGSLLATYHFGQAGVDSLRPYVSGGFGHQSRTNVLADGHSGRDQSTLAIIGTGVKYYFTDNLFARAGVEADYAMDNGKWDYSALVGLGVNFGGNAGKVAPAPAPVPEPTPEPEAPVAEVVRVELDVKFDFDKSVVKPNSYADIKNLADFMKQNPQTTTVVEGHTDSVGPDAYNQKLSERRANAVKQVLTSQYGVESSRVQSVGYGESRPVADNATEAGRAVNRRVEAQVEAQAQ

SEQ ID NO: 22520 - protein, 343 aa, Pseudomonas chlororaphis
MKLKNTLGFAIGSLIAATSFGALAQGQGAVEIEGFAKKEQFDSARNFKNNGNLFGGSVGYFLTDDVELRLAYDEVHNARTDDGTNVKGANTALDALYHFNNPGDMLRPYVSAGFSDQSIDQNGSTRNRSTFANVGGGAKLYFTENFYARAGVEAQYNIDQGDTEWAPSVGIGVNFGGGSKPAAAPVPAPAEVCSDSDNDGVCDNVDKCPDTPANVTVDADGCPAVAEVVRVELDVKFDFDKSVVKPNSYGDIKNLADFMKQYPSTSTTVEGHTDSVGPDAYNQKLSERRANAVKQVLTNQYGVESSRVQSVGYGESRPVADNATEAGRAVNRRVEAQVEAQAK

SEQ ID NO: 22521 - protein, 344 aa, Pseudomonas cichorii
MKLKNTLGLAIGTIVAATSFGALAQGQGAVEIEGFAKKEYYDSDRNFKNDGNLFGGSVGYFLTDDVELRLGYDEVHNVRSDSGKNIKGANTALDALYHFNNPGDMLRPYLSAGFSDQSIGQDARNGRDGSTFANIGGGAKLYFTDNFYARAGVEAQYNIDQGNTEWAPSVGIGVNFGGGSKKVEAAPAPVAEVCSDSDNDGVCDNVDKCPDTPANVTVDADGCPAVAEVVRVELDVKFDFDKSVVKPNSYGDIKNLADFMQQYPQTTTTVEGHTDSVGPDAYNQKLSERRANAVKQVLVNQYGVGASRVNSVGYGESRPVADNATEAGRAVNRRVEAEVEAQAK

SEQ ID NO: 22522 - protein, 325 aa, Pseudomonas fuscovaginae
MKLKNTLGIAIGSIVAVTSFGVLAQGQGAVEGELFYKKQYNDSVNHVEDGFNPGASIGYFLTDDLSLNATYDKTNHTRSNDGTGNQKIKGDNFGLNAQYHFGTVGDALRPYVSGGVAHKSMTNVEADGHSGRDQSTFLTAGAGVKWYITDNLFARAGVEADYKLDNGKWDYAPTIGLGVNFGGSGGKVAPAPVAPAPAPEPAPEAPVAEVVRVELDVKFDFDKSVVKPNSYADIKNLADFMKQYPQTTTVVEGHTDSVGPDAYNQKLSERRANAVKQVLVNQYGVGANRVQSVGYGESRPVADNATEAGRAVNRRVEASVEAQAK

SEQ ID NO: 22523 - protein, 350 aa, Pseudomonas mendocina
MKLKNTLGVVIGSLVAASAMNAFAQGQNSVEIEAFGKRYFTDSVRNMKNADLYGGSIGYFLTDDVELALSYGEYHDVRGTYETGNKKVHGNLTSLDAIYHFGTPGVGLRPYVSAGLAHQNITNINSDSQGRQQMTMANIGAGLKYYFTENFFAKASLDGQYGLEKRDNGHQGEWMAGLGVGFNFGGSKAAPAPEPVADVCSDSDNDGVCDNVDKCPDTPANVTVDANGCPAVAEVVRVQLDVKFDFDKSKVKENSYADIKNLADFMKQYPSTSTTVEGHTDSVGTDAYNQKLSERRANAVRDVLVNEYGVEGGRVNAVGYGESRPVADNATAEGRAINRRVEAEVEAEAK

SEQ ID NO: 22524 - protein, 346 aa, Pseudomonas resinovorans
MKLKNTLGLAIGTLVAATSLGALAQGQGAVEIEGNVTKQFYDSERNFKNDGTNPGVRLGYFLTDDVSLDLGYNETHNARGEVFNKDIKGSKTKLDATYHFGTVGDALRPYVSAGFAHESLGQATRSGRDHSTFANVGAGAKWYITDMFFARAGVEAMYNIDNGNTEWGPTVGLGLNFGGSGGQKAAPAPAPVAEVCSDSDNDGVCDNVDKCPDTPANVTVDADGCPAVAEVVRVELDVKFDFDKSVVKPNSYADIKNLADFMKQYPQTTTTVEGHTDSVGPDAYNQKLSERRAKAVKDVLTQQYGVESGRVSSVGYGETRPVADNATEAGRAVNRRVEAQVEAQAK

SEQ ID NO: 22525 - protein, 344 aa, Pseudomonas viridiflava
MKLKNTLGLAIGTIVAATSFGALAQGQGAVEIEGFAKKEYYDSDRNFKNDGNLFGGSVGYFLTDDVELRLGYDEVHNVRSDSGKNIKGADTALDALYHFNNPGDMLRPYVSAGFSDQSIGQDARRGRDGSTFANIGGGAKLYFTDNFYARAGVEAQYNIDQGNTEWAPSVGIGVNFGGGSKKVEAAPAPVAEVCSDSDNDGVCDNVDKCPDTPANVTVDADGCPAVAEVVRVELDVKFDFDKSVVKPSSYGDIKNLADFMQQYPQTTTTVEGHTDSVGPDAYNQKLSERRANAVKQVLVNQYGVGASRVNSVGYGETKPVADNATEAGRAVNRRVEAEVEAQAK

SEQ ID NO: 22526 - protein, 950 aa, Neisseria elongata
ESNMQTEKLETIVVSSEDDSVHNKNVGEIKKNAKALSKQQVQDSRDLVRYETGVTVVEKGRFGSSGYAIRGVDENRVAVVVDGLHQAETISSQGFKELFEGYGNFNNTRNGVEVENLKQAVIQKGADAIRTGSGSLGGTVSFESKDARDYLIDKNYHFGYKTGYSSADNQKLHSVTAAGRYSDFDLLAVHTQRHGNELRNYGYRHYDGSVVRKEREKADPYKITKQSSLIKIGYQLNDTNRFTLGYDDSRNTSRGTDWSNAFTSYNGGPFLKDVRHTNDQSNRKNISFVYENFDTNDFWDTLKITHNHQKIKLKARLDEYCDVNGEIDCPAIANPSGLYINDKGIFLDKHDGEITHKKEGEFNNYFDSKGKEVRVTGFNVDSILINCDQYDCSKPMQLLSSTNNGYGGSPNKYIYKTYELFEKTMNNGNGKYAVLEIRSSGHEKFSRVYLPSEKGYVENQWKDRDLNTDTQQYNIDLTKSFKLKSVEHNATYGGLYSEVKKSMTNRAGYEAYNRQWWANIFFGKENNKPNKCQPYNGNSFTTLCSHEDRLFSFLIPVKTKTGALYVTDKIKLNDKVNLDVAYRYDRIKHDPKYIPGTTPKLPTDLILGRFIEFKPKNTYATQDEKNENAEKNAVYLASKKTKFSANSYSATFSFDPMDFLKIQAKYATGFRAPTSDEIYFVFQHPSFSIYPNLYLKAERSKNKEVAITLHKQKSFLTVNLFQTDYKDFLDLAYLKKGSLPYGNGGSQLETLLYQNVNRDKARVKGLEVNSKLHLGDVWRTLDGFNLSYKLSLQKGRMSSKVGEEGKQRDTNKLDTPMNAIQPQTHVVGVGYEHPQEKFGVDMYLTHASAKKEKDTFNMFYDGKDQKDQRIKWRSDRYTLVDLIAYVKPVKNVTLRAGVYNLTNREYGTWDSIRSIRPFGTTNLINQETGKGIKRFNAPGRNFRVNAEITF

SEQ ID NO: 22527 - protein, 327 aa, Neisseria canis
EVAQTKVKTNGVETKSHTSTKISDFGSRIGFKGHEHLGSDLNAIWQVEQNTSVAGTDNGWATRESFVGLEGGFGKVRAGKLNTQLKDMDKIDPWEYKNPALGLGVFTRTGERVVSARYDSPVFAGFSANVQFTPRDNQAETGRNTDYSDTSAYYAGLNYENSGFFAQYGGAFKKSAYVGDNNKGKTGHAHQVQAGYDANNIFAALGYQYTNGWDTVGTYRAALAGLDKDADKDAYDALVRDTRRIKTHELAVTGAYRFGNVTPRVSYAHGFKAKGKNLTSDDKKATEYNQVVVGADYDFSKRTTAMVSAGWLRAGKRDNKVENTAGL

SEQ ID NO: 22528 - protein, 188 aa, Neisseria mucosa
ETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKEFGFAYQAKAGVSYDVTPEIKLYAGARYFGSYGASFNKEAVSATKEINVLYSAVGAEA

SEQ ID NO: 22529 - protein, 145 aa, Neisseria flava
EVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLRYGAATRASYGYDFAFFRNA

SEQ ID NO: 22530 - protein, 349 aa, Neisseria denitrificans
EVSKVNLGEKTATALGKEKSSKTATEIADLGSRIGFKGHEHLGSNLNAIWQVEQKTSIAGGDKEWASRESFIGLEGGFGKVRAGKLNSTVKDSSNNADQWESNNGALGLSVFTRVDKRAVSVRYDSPVFAGFSASVQYTPRDNVTLLNKYTHNDAPRDTYYAGLNYENSGFFGQYAGGFRKNSVDTTDENGKVTHKDGHVQRLVAGYDANNLFVSVAGQYAKNWEKLGDYAQAQSNGVVTKEMRERTTSPVNACNVVFGTDATLDGKGVETVEVAATAAYRAGNVTPRVSYAHGFKAKVDGKKLKGTQYDQVIVGADYDFSKRTTALVSTGWLRGAESGSHKVETISGL

SEQ ID NO: 22531 - protein, 332 aa, Neisseria animalis
EVSRTKMKVSDQAGKSETTKSKTATEIADFGSRIGFKGHEHLGSNLNAIWQVEQKTSIAGGDSGFANRESFIGLEGGFGKVRAGNLNTTLKDSSDSIDPWEAGANSDVLTLGKFERVDSREVSVRYDSPVFAGFSASVQYQPRDNANPNDKYGHKRASGDAYYAGLNYENSGFFARYAGGFAKHDLKTNEDGVVNDNPVNGTVKGDLKDHQTHRVVAGYDANNLLVAVAAQYDASKNGYADTSNAQTAYGKKNKQTEVAATGAYRFGNVTPRVSYAHGFKPTVDGKQVAGGQYNQVIVGADYDFSKRTSALVSAGWLKEGKGDNTKEKTAGT

SEQ ID NO: 22532 - protein, 340 aa, Neisseria cinerea
EVSRTKANFGSANEVKSATATEIADFGSRIGFKGHEHLGNNLNAIWQLEQNTSIAGTNSGWGTRESFIGLEGGFGKVRAGRLNSIVKDSTDSIDPWESSDANAHVLSLGAMKRVDERLTAVRYDTPVFGGFSASAQFAPRDNQNPNDRYAHEVATGETYFGGLNYENSGFFGRYAGGYRKHVLANDLTDGSTRALNKDGQVHRLILGYDANNLMVSVAGQFAKNWDTVDSYYNAISGGVATSAASAASAAIGEAGVEATEVAGTAAYRFGNVTPRVSYAHGFKAKVSNGAAKGTKLDASKYNQVIIGADYDFSKRTTALVSAGWMKAGQGDNKVESAAGL

SEQ ID NO: 22533 - protein, 196 aa, Wolbachia sp.
SYYVRLQYNGEFLPLFTKVDGITYKKDKSDYSPLKPSFIAGGGAFGYKMDDIRVDVEGVYSYLNKNDVKDVTFDSANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEA

SEQ ID NO: 22534 - protein, 187 aa, Wolbachia sp.
SYYVRLQYNGEVLPLFTKVDNMKIKKGTDDVDPFKASFIGGGAAFGYKMDDIRVDIEGLYSQLNKNVNNNEVLTPDTVADSLTAISGLVNVYYDIAIEDMPITPYVGVGVGAAYISTPLKDAVNGQKSKFGFAGQVKAGVSYDVTPEVKLYAGARYFGSYGANFDKSGGEKDKGGHTVLFSTVGAEA

SEQ ID NO: 22535 - protein, 751 aa, Pseudomonas fluorescens
MGTNIVTSTDNTGRFNLTVELGKYELHVVASAYVHKNIQVDLAKNQNPELTVQLDKSALEIIDVSATPFHSSNIESALPITVLHGESLRMRQANTLGDTLNKEVGVHSSFHGGVASTPIIRGLDGPRVLITQNGLDAGDASRVGPDHAVSTETSTSERIEVLRGPATLFYGSGAIGGVVNIVNESIPKSTETSGEWLTEYNSNNEQTLASGSFTSGTGNIAVHADGFYRDSENYQIPEKDGVDEVANSAAESSGFTLGTSYLLDNGFVGLSYQNLEQEYGIPGHSHGDEDIEVSADLTQNRFQLLSELSFDNNVIKSLNTKIGYTDYRHTEVELGLVGTTFDNESIEARVELLHQDFLDWRGGLSLHYKQSDFTAVGEEAFTPPSETNSLGLAWIEERHFGDFLVQLGARIERTEVTAAKVRLPELELVKSAHDDHGADDDAGHDSHDHGAHETQGYTRNFNVEHVFTPISLSAGLVWDFIDGYNVGLSLSHSERAPSAAELLSFGPHIGTGSYEVGALFALHDDHGEAAHFGLTDHDIVMETANNIDLSLRKFKGDFGFIFNVFYNQIDDYYYEQATGFSAGDGHDHSGHGHGGEVEEAHTLPLYTFTAQDVSLYGFEAQLVWQVTDEFTWRVQGDVLRARLDEGGELPRTPPARIATELSYQGESISADLFVSHYFEQTHTAELETSTDSYVMVDANVNYHFSLGQHDLAVYLKAINLTDEYAQVHTSFLKDLTPLAGRSVALGLRGSF

SEQ ID NO: 22536 - protein, 452 aa, Pseudomonas aeruginosa
MRGFPALTAPSDWRRPADLFSAAPVIGTRTAPAVLAVSLALAGPAGAGEDAFEGMAGPSGERLRYDAKGLTLTFPEPDVKLQIGGRLHIDGGAAGFGRPDLPEAFPDNVAVRRAWIEPTLTIGRDWVIAFQYDFADPMLPINDALVAWKGVPDTILTLGNMKEPFSLEWLQSNNDTLFAERSVANALVPERRFGFAAGHHGKNWTAVAGVFGNAASNGIDGDGVAVAARATVAPIMEGDETLHLGLAGVFRTRSRSDGAFGFSSPAGAFLFERPLVDTGDLPDAASVSRLGAELAYRRGPLLVQAEYIRAALQPFPGPSQPGAALDFQGGYVEAALVLNGEGRAYALTPQSGTTYATFRGVTVPEAQRLSRGGIGVFELAARYSAVDLDARGFRGGMEQDVTLGLSWYPEPNLRLIGNVVHGRVWPGEAQSDTLGTRPFSVDTVIARLQIYW

SEQ ID NO: 22537 - protein, 448 aa, Salmonella typhi
MASFRSSLLSALCAYGMMVMPAYAIDPNHPKLHHHKYSERLKKRHTEDSYLSSSSTLESSKTFAQEPRRHVLTPIRNVLADRPCEEGLSISKLFNSIEKETNSQISVDFTILPQWFYPKKGLLKAVDEKQPTWQFYVSPNVSWQLYNSPTAGVGSIDFSYTLVRYWRNNAQNANNAIGIAGGINDYSTRTNTLSQLTFSQTFPENILTISFGQYSLYSIDGTLYDNDQQSGFLSYALSQNASATYSSGSVGAYLQFTPTPSINIQAGFQDAYNVSGSSFDLYNLTRNRYNFYGYVSWAPQSSLGSGQYSALVYSTRKVPEQPVQTTGWSLNFGQHLGEKLYVFGRWNGATGTVTNLNRSYVLGLASANPINRNPQDLLGAACSMSKVNPKVITEKKIRKYETVIETFATIGFGPHISLTPDLQIYIHPARRPDKRAAKVYGVRANFST

SEQ ID NO: 22538 - protein, 1001 aa, Bordetella pertussis
MPDMPPVRRSLCSALIAAILGPLPAAAQVVNNPQYAIGEHVEIAAGDYATVNHDPVLNVSKGGLMTVAGPVRVFSKGIGAMGLSVHGAGSRIELQDSQVHTTGNSAYGLYLFNGSGAPNGASALLDNTTLNTLDDNAAGVRMYGAGNRLDMAGGSIDTLGREAYGIYVGPGPGASIAVGDTRIRTVGAFAPAIALGSDGNHAKLERIDVTTEGQESAALSQIGENTMTVADSTLRTNGVLAPAVDVREGAMTMARTDVITTGESSHGLYASRELALDAQTAQLDVADSRVTTQGLGAAGAIARDGAEVTVTGTAVETHGDKAIGALSVRDDSIASLVDSTVVTHGELARGVQASYGGLVDLVDTTVRTEGERAAGAGIFGGELHLDGGSIVSAQGSAIEATTGLVRASRGAHIEGGNGTLLAVAAKAGEPVHLLLDNATARGNIVNVPAEDGSPTPAVTNLALSRGAAWEGATQAVRALSMQGGSQWTVTGDSAVQGVRLDGSTIAFAAPAGGAHKTLVVHGDYAAKDGKVVLNTVYGDDLAPSDKLVIDGGRASGNTALVVKRTSGDGATTKVGIPLVETRNGGTTDAAAFALDAASDGYRKDFGTVSAGGYDYMLTRGGASGRADDWYLVSAAKPAPPEPPAPPQPPEPPAPPQPIDPETVPPKPEVVPPPVRAVAPEPDAYLANADAAILMPIHTLHERSDQTLRAETDENARDGAVWLRAQGLSTSLGGGNGSGGRSVSGNGRLLHVGADMFRLEDGRGGSFRIGAMGLYASATSWSTRTLWNPVAQRYMPATARGSIDGYNAGLYATWYGNRDILTGPHVDTWLMFGAYSNRIGGSLPSDSYRSRTLTASIEGGYSLGVYDDGRSRFFVEPAAQIVYANYQAKGHDSPGGYIGVQRSNDVLARIGVRVHGVTPISALQALRPFIEANWWHGPGSHQLSVDGNPFELRMPRDRAEFKLGATGQLTRNLSVSASVGVDSNFSNYATVKGQLAAKYRWR

SEQ ID NO: 22539 - protein, 385 aa, Neisseria meningitidis
MRKKLTALVLSALPLAAVADVSLYGEIKAGVEGRNFQLQLTEPSSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNTDVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRH

SEQ ID NO: 22540 - protein, 386 aa, Neisseria meningitidis
MRKKLTALVLSALPLAAVADVSLYGEIKAGVEGRNFQLQLTEQPQTANTQQGGKVKVTKAKSRIRTKISDFGSFIGFKGSEDLGEGLKAVWQLEQDVSVAGGGATRWGNRESFVGLAGEFGTLRTGRVANQFDDASQAIDPWDSNNDVASQLGIFKRHDDMPVSVRYDSPDFSGFSGSVQFVPAQNSKSAYTPAYVDEQSKYHAAVVGKPGSDVYYAGLNYKNGGFAGNYAFKYARHANVGRDAFELFLLGSGSDQAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22541 - protein, 357 aa, Neisseria meningitidis
MRKKLTALVLSALPLAAVADVSLYGEIKAGVEGRNYQLQLTEPPSKSQPQVKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAHYTRQNNADVFVPAVVGKPGSDVYYAGLNYKNGGFAGNYAFKYARHANVGRNAFELFLLGSTSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIV

SEQ ID NO: 22542 - protein, 384 aa, Neisseria meningitidis
MRKKLTALVLSALPLAAVADVSLYGEIKAGVEGNNIQLQLTEPPSKGQTGNKVTKGKSRIRTKINDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22543 - protein, 395 aa, Neisseria meningitidis
MRKKLTALVLSALPLAAVADVSLYGEIKAGVEGRNYQLQLTEAQAANGGAGASGQVKVTKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHK

SEQ ID NO: 22544 - protein, 300 aa, Neisseria meningitidis
MRKKLTALVLSALPLAAVADVSLYGEIKAGVEGRNIQAQLTEQPQVTNGVQGNQVKVTKAKSRIRTKISDFGSFIGFKGSEDLGEGLKAVWQLEQDVSVAGGGATQWGNRESFIGLAGEFGTLRTGRVANQFDDASQAIDPWDSNNDVASQLGIFKRHDDMPVSVRYDSPEFSGFSGSVQFVPAQNSKSAYTPAYFTADPNDQNKITRVPAVVGKPGSDVYYAGLNYKNGGFAGNYAFKYAKHANVGRDAFELFLLGSGSDEAKGTDPLKNHQVHRLTGGYEEGGLNLALAAQLDLSENA

SEQ ID NO: 22545 - protein, 704 aa, Helicobacter pylori
MKKTLLLSLSFLLHAEDDGFYMSAGYQIGEAAQMVSNTKGIQQLSDNYENLSKLLTRYSTLTNLIRLSSDPSTINEVRDNLGSSSRNLLDVKTNSPAYQAVLLALNAAVGLWQVTSYAFTACGPGEKENENGGIQTFNNVPGQDTTTITCNSYYQPGHGGPISTANYAKINQAYQIIQKALTANGSDGDGVPVLSNTTTKLDFTINGDKRTGGKPNEPLVYQWSHGKPISTSWVDTTATSTTETINTTNNAQELLKQASVIITTLNEACPNFQNGGSRYWPGISGNGTMCGMFANEISAIQGMIANAQEAVAQAKIVSENTQNQSNLDTAKPFNPYTDASFAQGMLANAQAQAEILNQAEQVVKNFEKIPTAFVNGSLGVCYQMEGGERRGTNPGQTTTNTWGAGCAYVEQTITNLSNSIAHFGTQEQQIEQAENIADTLVHFKSRYSELGNTYNSITTALSKVPNAQSLQNVVSKKNNPYSPQGIETNYYLNQNSYNQVQTINQELGRNPFRKLGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGVKIPTINTNYYSFMGAELKYRRLYSVYLNYVFAY

SEQ ID NO: 22546 - protein, 666 aa, Helicobacter pylori
MKKTLLLSLSLASSLLNAEDNGFFISAGYQIGEAAQMVKNTGELKKLSDTYENLSNLLNNFNNLNQAVTNASSPSEINAAIDNLKANTQGLTGEKTNSPAYQAVYLALNAAVGLWNVIAYNVQCGPGKSGGQSVTFEGQPGHNSSSINCNLTGYNNGVSGPLSIENFKQLNQAYQVLQQALKQGVPALNNTNQKIEVKVTTQTNGANKSETTTTTTTNDAQTLLQEASKMINVLTTNCPWVNHNPGQNGGTPWGLDTAGNVCQVFATEFSAVTSMIKNAQEIVTQAQSLNANQNNQNAPQDFNPYTSADRAFAQNMLNHAQAQAKMLELAAQMKKDLNTIPSQFIANYLAACRTDGTTPNQGVTSNTWGAGCAYVEETITALNNSLAHFGTQAEQIKQSELLARTILDFRGSLSNLNSTYNSITTTASNTPDSPFLKNLISQSTNPNNPGGLQAVYQVNQSAYSQLLSATQELGHNPFRRVGLISSQTNNGAMNGIGVQVGYKQFFGEKRRWGLRYYGFFDYNHAYIKSSFFNSASDVFTYGVGTDVLYNFINDKATKNNKISFGVFGGIALAGTSWLNSQYVNLATFNNFYSAKMNVANFQFLFNLGLRMNLAKNKKKASDHAAQHGVELGVKIPTINTNYYSLLGAQLQYRRLYSVYLNYVFAY

SEQ ID NO: 22547 - protein, 699 aa, Helicobacter pylori
MKKTLLLSLSLASSLLNAEDNGFFISAGYQIGEAAQMVKNTGELKKLSDTYENLSNLLTNFNNLNKAVTNASSPSEINAAIDNLKANTQGLTGEKTNSPAYQAVYLAINAAVGLWNVIGYAIMCGNGNGTGSGPGSVVFNNQPGSGTTSITCNRYESTGPGKSMSIQEFEKLNKAYQAIQQALKAQHGFPVLDQKGTEVTVTYTYECKQTADINGGVNQFCNKNGNSNGVTSSNQNHKETQSFEFTNTAQNLLEQASAIMNVLNTQCPLVRSTHNENTSGNGSPWNINTSGNACQIFSAEFSAVTSMIKNAQEIVAQAQSLNNPQNNQNAPQDFNPYTSADRAFAQNMLNHAQAQAKMLELANQIKTNLSAIPQHFTKDYLAACRNGGGTLPDAGVTNNTWGAGCAYVEETITALNNSLVHFGTQAEQIKQSELLARTIFDFKGSLKDLNSTYNSITTTASNTPNSPFLKNLISQSTNPNNPGGLQAVYQVNQSAYSQLLSATQELGHNPFRRFGLISSQTNNGAMNGIGVQIGYKQFFGEKRKWGARYYGFFDYNHAYIKSSFFNSASDVFTYGVGTDVLYNFINDKATKNNKISFGVFGGIALAGTSWLNSQYVNLATFNNFYSAKMNVANFQFLFNLGLRMNLAKNKKKASDHAAQHGVELGVKIPTINTNYYSLLGTQLEYRRLYSVYLNYVFAY

SEQ ID NO: 22548 - protein, 699 aa, Helicobacter pylori
MKKTLLLSLSLASSLLNAEDNGFFISAGYQIGEAAQMVKNTGELKRLSDTYENLSNLLNNFNNLNQAVTNASSPSEINATIDNLKANTQGLIGEKTNSPAYQAVSLALNAAVGLWNVIGYAIMCGNGNDTGGGPGSVVFNNQPGSHSTSITCNRYEATGPGKSMSIQEFEKLNKAYQAIQQALKEQNGFPVLDNKGTEVTVTYTYECKQTANINGGVNQFCNKNDSNNGVTSSGSNNKETQSFNFTNTAQNLLEQASTIMNVLNTQCPLVRSTHDENNAGNGSPWEINTDGDSCQIFSAEFSAVTSMIKNAQEIVTQAQSLNNQQSNQNAPQDFNPYTSADRAFAQNMLNHAQAQAKMLELAAQMKKDLNTIPSQFITNYLAACRNGGGTLPNAGVTNNTWGAGCAYVEETITALNNSLAHFGTQAEQIKQSELLARTILDFRGSLSTLNNTYNSITTTASNTPNSPFLKNLISQSTNPNNPGGLQTVYQVNQSAYSQLLSTTQELGHNPFRRVGLISSQTNNGAMNGIGVQVGYKQFFGEKRRWGLRYYGFFDYNHAYIKSSFFNSASDVFTYGVGTDVLYNFINDKATKNNKISFGVFGGIALAGTSWLNSQYVNLATFNNFYSAKMNVANFQFLFNLGLRMNLAKNKKKASDHAAQHGVELGVKIPTINTNYYSLLGTQLEYRRLYSVYLNYVFAY

SEQ ID NO: 22549 - protein, 248 aa, Helicobacter pylori
MLKRIILLGALGVGASAEESAAFVGVNYQVSMIQNQTKMVNDNGLQKPLIKFPPYAGAGFEVGYKQFFGKKKWFGMRYYGFFDYAHNRFGVMKKGIPVGDSGFIYNSFSFGGNTLTERDSYQGQYYINLFTYGVGLDTLWNFVNKENMVFGFVVGIQLAGDSWATSISKEIANYAKHHSNSSYSPANFQFLWKFGVRTHIAKHNSLELGIKVPTITHRLFSITNEKGYTLQADVRRVYAFQISYLRDF

SEQ ID NO: 22550 - protein, 355 aa, Helicobacter pylori
MLNFLIINIEEIQMKKTIIALSIAGFVASVQAAPQANTFYAGAKAGWASFHDGLNQFEDSSQKKGTVRNSVAYGIFGGYQITDHVAVELGSEYFGQAKGRKDKDEAKHTAQGMQLGLKASYPVLEGLDIYGRVGAALIRSNYLNVEKFESGKDVKNTLKVSPVFAAGVEYSLPSLPELALRLEYQWVKGVGKALKKSSGERLDYTPSIGAVTLGLSYRFGQKPVMAPEVVNKVFSLNSDVNFAFAKDTLKPEAQQTLDGVYGEIAQLKTAQVSVAGYTDRIGSDASNLKLSQRRADTVANYLVSKGVAQDAISAVGYGEANPVTGAKCDAVKGRKALIACLAEDRRVEISVKGSK

SEQ ID NO: 22551 - protein, 470 aa, Helicobacter pylori
MKNTNTKEIKNTRMKKGQYHALKKGLLKTALLFSLPLSVALAEDDGFYMGVGYQIGGAQQNINNKGSTLRNNVIDDFRQVGVGMAGGNGLLALATNTTMDALLGIGNQIVNTNTTVGNNNAELTQFKKILPQIEQRFEANKNAYSVQALQVYLSNVLYNLVNNSNNGSNNGVVPEYVGIIKVLYGSQNEFSLLATESVALLNALTRVNLDSNSVFLKGLLAQMQLFNDTSSAKLGQIAESLNKSGGAGAMLQKDVKTISDRIATYQENLKQLGGMLKNYDEPYLPQFGPGTSSQHGVINGFGIQVGYKQFFGSKRNIGLRYYAFFDYGFTQLGSLSSAVKANIFTYGAGTDFLWNIFRRVFSDQSLNVGVFGGIQIAGNTWDSSLRGQIENSFKEYPTPTNFQFLFNLGLRAHFASTMHRRFLSASQSIQHGMEFGVKIPAINQRYLKANGADVDYRRLYAFYINYTIGF

SEQ ID NO: 22552 - protein, 485 aa, Helicobacter pylori
MKNHSFKKTIALSLLAGMSLCRAEEDGAFFVIDYQTSLARQELKNPGFTQAQELKQLIRDGAVRLQTSAIPLSYYLDILGNKTTALLRESLKNNTQPSQPNAQPQNGPSNQALANLEESLGILGKLLDLSQQYASEGVIKPLVVDVGKEQIGITDSMLLVAQNIVLALGQVDLSKIQQNNNQQLYENIMKVMLLGAGGTNGAYNGVSVGDIATGMQNFSSQTGLIGANSTVSELNALIKSGISLDRETLGLGSFIEKNICSSASPCFTGSQLIYRKGLDRTINIINAVLGQFESSASSLYKISYIPNLFSLKDYQSASMNGFGAKMGYKQFFTHKKNVGLRYYGFLDYGYANFGDTNLKVGANLVTYGVGTDFLYNVYERSRRRERTTIGLFFGAQIAGQTWSTNVTNLLSGQRPDVKSSSFQFLFDLGVRTNFAKTNFNKHRLDQGIEFGVKIPVIAHKYFATQGSSASYMRNFSFYVGYSVGF

SEQ ID NO: 22553 - protein, 1449 aa, Neisseria meningitidis serogroup B
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGRNPDQHRFSYQIVKRNNYKPDNSHPYNGDYHMPRLHKFVTDAEPVEMTSDMRGNTYSDKEKYPERVRIGSGHHYWRYDDDKHGDLSYSGAWLIGGNTHMQGWGNNGVVSLSGDVRHANDYGPMPIAGAAGDSGSPMFIYDKTNNKWLLNGVLQTGYPYSGRENGFQLIRKDWFYDDIYRGDTHTVFFEPRSNGHFSFTSNNNGTGTVTETNEKVSNPKLKVQTVRLFDESLNETDKEPVYAAGGVNQYRPRLNNGENLSFIDYGNGKLILSNNINQGAGGLYFEGDFTVSPENNETWQGAGVHISEDSTVTWKVNGVANDRLSKIGKGTLHVQAKGENQGSISVGDGTVILDQQADDKGKKQAFSEIGLVSGRGTVQLNADNQFNPDKLYFGFRGGRLDLNGHSLSFHRIQNTDEGAMIVNHNATTTSTVTITGNESITQPSGKNINRLNYSKEIAYNGWFGEKDTTKTNGRLNLVYQPAAEDRTLLLSGGTNLNGNITQTNGKLFFSGRPTPHAYNHLGSGWSKMEGIPQGEIVWDNDWINRTFKAENFHIQGGQAVISRNVAKVEGDWHLSNHAQAVFGVAPHQSHTICTRSDWTGLTNCVEKTITDDKVIASLTKTDISGNVSLADHAHLNLTGLATLNGNLSANGDTRYTVSHNATQNGNLSLVGNAQATFNQATLNGNTSASGNASFNLSNNAAQNGSLTLSDNAKANVSHSALNGNVSLADKAVFHFENSRFTGQLSGSKDTALHLKDSEWTLPSGTELGNLNLDNATITLNSAYRHDAAGAQTGSVSDTPRRRSRRSLLSVTPPTSVESRFNTLTVNGKLNGQGTFRFMSELFGYRSDKLKLAESSEGTYTLAVNNTGNEPVSLDQLTVVEGKDNKPLSENLNFTLQNEHVDAGAWRYQLIRKDGEFRLHNPVKEQELSDKLGKAEAKKQAEKDNAQSLDALIAAGRDAAEKTESVAEPARQAGGENVGIMQAEEEKKRVQADKDSALAKQREAETRPATTAFPRARRARRDLPQPQPQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIGRFDIGISTGAGFSSGSLSDGIGGKIRRRVLHYGIQARYRAGFGGFGIEPYIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 22554 - protein, 727 aa, Rhizobium leguminosarum
MARVFLNVSNNVSRIYNDSLFVATAILLIGVAASPALAQSASTDGSATTLEPIVIQGASSDSKSDRTSVAAKNSSAATKINTPLVETPRSVSVTTEREIEQRGAQSIIEAVRYSAGVTTGPNGFDPRFDQIFIRGFNVTTVGDYRDSLRQPYINYGMFRTDPYQLQRVEVIKGPVSVLYGSGSPGGLVNKISKLPTEEPIHEVGISYSTKDRAQAMFDFGGPISEGNDDFLYRIVGLARHGDTNFDIADDRYFLAPSFTWKPDEGTTFTLYGLVQADETDSNVGAITTLDGRILDIRQSDPDYDYQKVKQQQVGYQFEHEFDNGLTFRHNLRYSHLDLRARYLGVSSWTGTVAHRNASSIRDEMNVFQVDNQLEAKFDTGPIAHTMLFGLDYTNLQSNWGYGIGAVNPAFDFDIANPTYGVSGATPAYNFIVADADMRQVGVYAMDQIEAGNWRFNLGGRQTWVNQTRDTTYTSLGLNASEDVSKNALSWQTGALYRFDNGIAPFVSYATSFDPVTNRSASGKILEPTEGEQYELGVKYQPPGTDILLSAVAYHIVEKNKPVLANPLTLAYNSLGEVTGTGIELEARAAVADGLDLIAAYTYNHSEVTGGGENEGNTPAVTPSHVASLWANYTFQEMNPFNGLSVGAGVRYVSENWTDTANTSKNPSGFYVDASAAYDFGAVDKKYEGLTAAFNIRNIADERDTVCNEGFCYLGQGRNITGTLKYRW

SEQ ID NO: 22555 - protein, 377 aa, Neisseria meningitidis
MRKKLTALVLSALPLAAVADVSLYGEIKAGVEGNNIQLQLTEQPSKGQVGNKVTKGKSRIRTKINDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPAQNSKSAYTPAYVDSKYHAAVVGKPGSDVYYAGLNYKNGGFAGNYAFKYARHANVGRDAFELFLLGSGSDQAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVFGAWLKRNTGIGNYTQINAASVGLR

SEQ ID NO: 22556 - protein, 258 aa, Zymomonas mobilis
MLNGMFDFGGKNDGVSGFIGGGVGVARVALNHYSLGGSGSFANDNDAHFAWQVIAGIRKPVTKMIDFELKYRFFNVNGLNFRTTDMGNMSGRYRSHSVLAGLVFNFGEPKAAQPAPPPMPAPPPPTPPAPPPPEEPPAPPVPAIPGPFLVFFDFDKYNITPEAASILDNVASSYAQTGQARVVVAGYTDTAGPAKYNMGLSQRRADSVKAYLVGKGVPDDAMATEAYGKTHLLVQTADGVREPQNRRVEITFGPGSGQ

SEQ ID NO: 22557 - protein, 706 aa, Porphyromonas gingivalis
MKKFFFALLSIGISAQAFAKTDNVPTDSLRVHNLQTVTVYSTRTAVPLKKIPAKMELIPSRNIKQSGFNNMTDILKTQSSLDVIQYPGFSSNIGIRGFKPSGKYVTVLVNGIPAGTDNISTLNTSNIEQIEILKGPFSSIYGTNAMGGVVNIITHKSKDKIHGNVSLFGGSYQTMAGSFNLGGRFEDIFSFDLSLGLDKQNKDYKTGSNNFLSLSKLEEAIVDVNATKNKKMKGSDYTVATGRLRFGIDFTPEWSLNLYQNVFLGDAIPVGGSIWGVYGESKKNLNRSSTSFELLGKQGCHTLQFSPYFNIEKSENYNNADPTGFINYKSDYYTYGALLQDKISFGGQNIVLGVDSRNMTMESERFEQAGVNTKPYNPGYATNNIGLFGQANFYLLNDALSISAGARADFMFFDLKANEYLNNEAKQETHNVINPNVGIKYEFVKGLTAHGTFGSAFTAPDAFQKAGQYVGPFGTTIGNPDLKPEKSMTWDFGIGYSNARCGIHADVTYFHTDHKDLILSSPDYANNITTYINADKARMSGIEALLSYDFGSLFANKFSLRAFANATIMLNSEMKKSQTDAPWSEMYYVRKQNITFGIEYRGKEGLEVMLNGRFMGRRIEQNWYAYYPEVRPELQQLLAAEEPELAAQGLLRHPQAMVFNASAYYHMNKYLTFGVNLNNILDELYTEKDGYHMPGRNIMGKVMVNF

SEQ ID NO: 22558 - protein, 415 aa, Acinetobacter sp.
MQYSTTRLYQFMLRMGVTFGMVGCIGVIPTVVNAQDNWTLSLKNAYIDRDYDGNAVKDTGSWSQGASLFYKSDYYKTPIDGLEIGVDGSVQYAVRLSHDKGVADTILPFDPVSQKQARDYLKYGGTLKLKYDQTELRVGELWPDLPVTAVDRSRQLLTSYQGVSLNSKLTSKLTGEIGIISKVSPRNEEDFRKLTFTKNGIKYVSDGLNYIDLKYQVLPNLKLEYYFGNLENLYNKHYLGADYSYKLSPEASLHTKLKYFNASEDNKNYNIDSQNFGILETLKYRNHTVGLGYQQIVGDAYPLPDGFLPETYFINWNTTGFFKSDEKSVHFIYGYDFKDYVPGLNFTFKHVYGYDFKTATGLKNKEQESNFILNYAFQNPKLKGVGFQWLYIPYKVRYGTDFNENRLFLTYTKKF

SEQ ID NO: 22559 - protein, 147 aa, Rickettsia australis
GGTRNDVDSFGLQWTLPPVYEAHPGGWRITASPELQINQHRHEGDKLVQGGAFATFRFEPPMQTIRPYLELGLGAHVFSRNDLGSKEFSTRFQFGELVGAGFSWGGEAPGGRGETWLGARLMHYSNAGIKHPNPGLETFQVILGHRF

SEQ ID NO: 22560 - protein, 2249 aa, Rickettsia australis
MANISPKLFKKAIQQGLKAALFTTSTAAIMLSSSGALGVATGVIATNNNAAFSNNVGNNNWNEITAAGVANGTPAGGPQNNWAFTYGGDYTVTADAADRIIKAINVAGTTPVGLNITQNTVVGSIITKGNLLPVTLNAGKSLTLNGNNAVAANHGFDAPADNYTGLGNIALGGANAALIIQSAAPSKITLAGNIDGGGIITVKTDAAINGTIGNTNALATVNVGAGTATLGGAVIKATTTKLTNAASVLTLTNANAVLTGAIDNTTGGDNVGVLNLNGALSQVTGDIGNTNSLATISVGAGTATLGGAVIKATTTKLTDAASAVKFTNPVVVTGAIDNTGNANNGIVTFTGNSTVTGNVGNTNALATVNVGAGLLQVQGGVVKANTINLTDNASAVTFTNPVVVTGAIDNTGNANNGIVTFTGNSTVTGDIGNTNALATVNVGAGTATLGGAVIKATTTKLTNAASVLTLTNANAVLTGAIDNTTGGDNVGVLNLNGALSQVTGNIGNTNSLATISVGAGTATLGGAVIKATTTKLTDAASAVKFTNPVVVTGAIDNTGNANNGIVTFTGNSTVTGDIGNTNSLATISVGAGTATLGGAVIKATTTKLTNAASVLTLTNANAVLTGAIDNTTGGDNVGVLNLNGALSQVTGDIGNTNSLATISVGAGTATLGGAVIKATTTKITNAVSAVKFTNPVVVTGAIDSTGNANNGIVTFTGNSTVTGDIGNTNALATVNVGAGTATLGGAVIKATTTKLTNAASVLTLTNANAVLTGAIDNTTGGDNVGVLNLNGALSQVTGDIGNTNSLATISVGAGTATLGGAVIKATTTKLTNAASVLTLTNANAVLTGAVDNTTGGDNVGVLNLNGALSQVTGDIGNTNSLATISVGAGTATLGGAVIKATTTKLTNAASVLTLTNANAVLTGAIDNTTGGDNVGVLNLNGALSQVTGDIGNTNSLATISVGAGTATLGGAVIKATTTKLTDAASAVKFTNPVVVTGAIDNTGNANNGIVTFTGNSTVTGNVGNTNALATVNVGAGLLQVQGGVVKANTINLTDNASAVTFTNPVVVTGAIDNTGNANNGIVTFTGNSTVTGNVGNTNALATVNVGAGLLQVQGGVVKANTINLTDNASAVTFTNPVVVTGAIDNTGNANNGIVTFTGNSTVTGDIGNTNALATVNVGAGITLQAGGSLAANNIDFGARSTLEFNGPLDGGGKAIPYYFKGAIANGNNAILNVNTKLLTASHLTIGTVAEINIGAGNLFTIDASVGDVTILNAQNINFRARDSVLVLSNLTGVGVNNILLAADLVAPGADEGTVVFNGGVNGLNVGSNVAGTARNIGDGGGNKFNTLLIYNAVTITDDVNLEGIQNVLINKNADFTSSTAFNAGAIQINDATYTIDANNGNLNIPAGNIQFAHADAQLVLQNSSGNDRTITLGANIDPDNDDEGIVILNSVTAGKKLTIAGGKTFGGAHKLQTILFKGAGDCSTAGTTFNTTNIVLDITGQLELGATTANVVLFNDAVQLTQTGNIGGFLDFNAKNGMVTLNNNVNVAGAVQNTGGTNNGTLIVLGASNLNRVNGIAMLKVGAGNVTIAKGGKVKIGEIQGTGTNTLTLPAHFNLTGSINKTGGQALKLNFMNGGSVSGVVGTAANSVGDITTAGATSFASSVNAKGTATLGGTTSFANTFTNTGAVTLAKGSITSFAKNVTATSFVANSATINFSNSLAFNSNITGGGTTLTLGANQVTYTGTGSFTDTLTLNTTFDGAAKSGGNILIKSGSTLDLSGVSTLALVVTATNFDMNNISPDTKYTVISAETAGGLKPTSKENVKITINNDNRFVDFTFDASTLTLFAEDIAADVIDGDFAPGGPLANIPNAANIKKSLELMEDAPNGSDARQAFNNFGLMTPLQEADATTHLIQDVVKPSDTIAAVNNQVVASNISSNITALNARMDKVQSGNKGPVSSGDEDMDAKFGAWISPFVGNATQKMCNSISGYKSDTTGGTIGFDGFVSDDLALGLAYTRADTDIKLKNNKTGDKNKVESNIYSLYGLYNVPYENLFVEAIASYSDNKIRSKSRRVIATTLETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYRINYDTNIGSKYFAQQGSVKVRVNF

SEQ ID NO: 22561 - protein, 732 aa, Shigella flexneri
  misc_feature (410)..(410): Xaa can be any naturally occurring amino acid
MMRKKYMPRALGPLLLVVLSPAVAQQNDDNEIIVCASRSNRTIAEIAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNGSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITXLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLSLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 22562 - protein, 264 aa, Salmonella typhimurium
MSVYLRADDLVTYTIIKKEDLGFQRFLAKKCLRGKAPPCFAEPKKPKKKLFNIDKSSHYYGTSVVQMSWLQSRERFENHSKYRDIPFAEVSLIYGYKQFFPKKERYGFRFYVSLDYAYGFFLKNKGVLGDSLRESSQIPKSYREKLQRKETFINAIFYGAGADFLYKRAFGTLILGMNFVGETWFYETKIFKKWAKDPLSVYHPYMFQVMLNVGYRYRFSRYKNWAIELGARIPFLTNDYFKTPLYTLHFKRNISVYLTSTYDF

SEQ ID NO: 22563 - protein, 321 aa, Pseudomonas stutzeri
MKLKNTLGVVIGSMVAATSVNALAQGQGAVEVEAFGKHYFTDSSRDIKNGELYGAGVSYFLTDDVSLGLSYGEYHDITSEDRVQDGSHKKIKGSLTSLDAAYHFGNPGVGLRPYVSAGVAHQSIGQADRGGRDRSTFANVGTGLKYYFTENFFAKASVDGMYNIDADEGEWMAGVGVGLNFGGGARQVAAVEPTPEPAPAPIVDNEPEPAPEVVRVELDVKFDFDKSRVREESYSDIKNLADFMQQYPQTTTVVEGHTDSVGTDQYNQRLSERRAEAVRNVLVNEYGVQGNRVNSVGYGESRPVADNSTEEGRQINRRVEA

SEQ ID NO: 22564 - protein, 344 aa, Pseudomonas sp. DC
MKLKNTLGLAIGTIVAATSFGALAQGQGAVEIEGFAKKEMYDSARDFKNNGNLFGGSIGYFLTDDVELRLGYDEVHNVRSDDGKNIKGANTALDALYHFNNPGDMLRPYVSAGFSDQSIGQNGRNGRNGSTFANIGGGAKLYFTDNFYARAGVEAQYNIDQGDTEWAPSVGIGVNFGGGSKKVEAAPAPVAEVCSDSDNDGVCDNVDKCPDTPANVTVDADGCPAVAEVVRVELDVKFDFNKSVVKPNSMGDIKNLADFMQQYPQTTTTVEGHTDSVGPDAYNQKLSERRANAVKQVLVNQYGVGASRVNSVGYGESRPVADNATDAGRAVNRRVEAEVEAQAK

SEQ ID NO: 22565 - protein, 328 aa, Pseudomonas stutzeri
MKLKNTLGVVIGSMVAATSLSALAQGQGAVEVEAFGKHYFTDSSRDVQRDGELYGAGVSYFLTDDVSLGLSYGEYHDLTSKDPVGADGSHKNIKGSLTSLDAAYHFGAPGVGLRPYVSAGVAHQSIGQADRGGRDRSTFANVGTGVKYYFTENFFAKASVDGMYNIDADEAEWMAGVGVGLNFGGGARQVAAVEPTPEPAPAPIVDTEPEPAPEVVRVELDVKFDFDKSRVREESYSDIKNLADFMQQYPQTTTVVEGHTDSVGTDQYNQRLSERRAEAVRNVLVNEYGVQGNRVNSVGYGESRPVADNSTEEGRQINRRVEAAVNSY

SEQ ID NO: 22566 - protein, 323 aa, Pseudomonas stutzeri
MKLKNTLGVVIGSMVAATSLSALAQGQGAVEVEAFGKHYFTDSSRDVQRDGELYGAGVTYFLTDDVSLGLSYGEYHDLTSKDPVGADGSHKNIKGSLTSLDAAYHFGAPGVGLRPYVSAGVAHQSIGQADRGGRDRSTFANVGTGVKYYFTENFFAKASVDGMYNIDADEAEWMAGVGVGLNFGGGARQVAPVEPTPEPAPAPIVDTEPEPAPEVVRVELDVKFDFDKSRVREESYSDIKNLADFMQQYPQTTTVVEGHTDSVGTDQYNQRLSERRAEAVRNVLVNEYGVQGNRVNSVGYGESRPVADNSTEEGRQINRRVEA

SEQ ID NO: 22567 - protein, 318 aa, Pseudomonas stutzeri
MKLKNTLGVVIGSLVAATSFGALAQGQGAVEVEGFVNRYFTDSQRDFAHDEGNLFGGSIGYYLTDDVELALSYGEYHDLRGEGSRGSKNIKGNLTDLKAIYHFGQPGVGLRPYVSAGFGHQSIGDANGGGRNHSTLAIAGAGAKYYFTEMFYARAGVDALYNIDQGDTEWQAGVGVGLNFGGGSKPAPAPVVAAAPEPMPEPAPEPALETVRVELDVKFDFDKDRVKEESYGDIKNLADFMNQYPQTTTTVEGHTDSVGSDAYNQGLSERRANAVRNVLVNQYGVDGSRVNAVGYGETRPVADNATDSGRAINRRVEA

SEQ ID NO: 22568 - protein, 1066 aa, Vitreoscilla sp.
MRFIPLLCLLLAFVFCNYAGGADLPSSFDLRNIDGRSYIGPVRNQKKCGSCWSFGTLAAAESTWNRVHGLYDDQAIDFSEAFLTWSLSPLYDGLHGCDGGSLDLQQNTALIEYGVPLESDFPYTMTDPGSDLHWDATRYSFLDWYRIPPSDIETTRRILYHIGAVTAGVLVEDDFYAYSGGILTNQNTAINNPLPYESSANHLVALVGWNDEPGDDGLGYWILRNSWSENWGDNGYVNIRYTTAKVALHSAYMMLEPWSGANVVLENQEDLSATPWSAGGTLNAHGLDLWGGAASSVTNRGTILAEAYAETELATARGVYLWGGPEGQVINEKLIGALASSDNNQASAYAICLQGGLVDNSGQLLALATSHADQALAFGVWAANGGNPLEIRNNGLVLAWAQNSGTNAGYGIWADSRYLTEVTNSGSIFAFADTYAVGVLLSGGPAVLNNSGTILAAASLEDPDILSGTSIGLLATKKTTILNSGTISGAYASIKSEDDTLLVLETGSDLIGTAYLKGNSDVVWLNGSGSEDTSFYGVETLLMAGDDWSLSGASAFGSIEVALGRLGVDGALAGETSVLAEGILGGNGSVTGTVANGGTVAPGHSVGHLTVVGDYAQTADGTLEIEIGDGIADLLTVTGTADLAGTLLILPDGYATGGSYTFLEAGTIAGAFETLTSAAVLSVTLDDATPGSLSLDVTRNSYTALSSPHNRGLASTLDGLRSTADGDFGSLLDSLDLALSQSALNDALASLTPRIHGLASTVILNDAQTRLGDLRRRLQRVDPDMQPEGKPSAWFEILGEDNRYGSDGGYFGAREELYGLLLGMHRSTSGGLTLGVAAAVSESRLDGRDGNDDSEIKSQQGYLYAAWREPRRADGMHMEAVVGGGLCQLDTDRSIPFAGRRPHSEHDGSLIGATFNGGYTLDVNGWIIDPGAGLSFVHLREESFRESGANSADLKIAARDNDSLQSQLGVRLSHPLRLDTLTLQPELRIEWQHEFNRKTEALQARLAGGDTFITPGRDLAGDGLLLGASLRARMSDNVFGMLDYTCDLQSHGAAGHALRLHLAVMF

SEQ ID NO: 22569 - protein, 575 aa, Helicobacter pylori J99
MKIKKNIFTMIWTTLSVVIFTLTQLSICQAEQVSEEPIANIPEVVEQKIVIRNITFVDPAKKKKSTTANLVITNKLFDLVTQDDIDVGHGDIIFDAQNGFILGSLESGKIANFLILDVDPHENIEALLDTKKHVLLAIHNGVIIRNNLRAESNISALAEQKRVKPKRTGWLSYTPPPIVLPSNYKDADWIKFDNDYFSTILIGALALDRQSWESQDKDSLAQVGDLQDFNGGEIRALRFGIAGAIKFDKPWIYMITGATNTFDKGFDTNTTDNVSFMDWRLDIPTIYNTTLSIGKQKEPISMERLMSMTFLPMQERALVSDALLPSRNFGAVLSGITLNQKLTWAGGVFNNWIEDEGSLSENSTELVGRTTWLPYLSEDENELIHLAFGLRYSNAKEGLRYASEPEFNKSTTFVDTGNIDADNSVTYNLEASWRKGPVWLIGEYTKSKVAADYLQNPELSGYHVSAVFSVTGEMREYNKRSGTFSPLRVARSVEQGGWGALEVSTRWSVFDGSDGGLAAGDTSILSVGFAWWLTPKFNVNFNYRWIDLDRCSFISEACNLQGRSSGFNTRLALFL

SEQ ID NO: 22570 - protein, 370 aa, Pseudomonas sp. G-179
MAHGQIGGLAKMGVKKRNPLAYPRRNSPVWASELKTEGKTMKKVLFATTALIATAGMAAAEVSMSGYGRFGLDYNSANERVAGVSETNITSRLRLQFDMSTEADSGVGFNARFRLQSESRDGAVNGGAANGTTTANGARFGVTYGGLSVNVGNIIGAVENTPGLYTTGTRSAGTGIDGMGFHSIAIKSRTGTAWNWDAYSSGGTGVNGLEAIYSANGFTGHVSYSQRNGGTVLGTAGGEDRSAIMLTYSFSDFYVAASAQSSSVAANDITFVSAGGDFGNFGARIAYGSTDAADSVTLEGNMDIGAASNILVWVNSTDVAGTVTAADTADGTSFGINYQYDLGGGATFVAGYVDEADDDNQFQAGVYFSF

SEQ ID NO: 22571 - protein, 326 aa, Neisseria gonorrhoeae
  misc_feature (323)..(323): Xaa can be any naturally occurring amino acid
MKKSLIALALAALPVAAMADVTLYGTIKVGVETSRSVDHTGRANRVKTATEIADLGSKIGFKGQEDLGNGLKAIWQLEQKAYVSGTNEGWGNRQSFIGLKGGFGKVRVGRLNSVLKDTGGFNPWEGKSDYLSLSNIAEPEARHISVRYDSPEFAGFSGSVQYELNDNSNKYNSESYHAGFNYKNSGFFVQYAGAYKRHHYATEKHQVHRLVGGYDHDALYASVAVQQQDAKLALIDDNSHNSQTEVAATVAYRFGNVTPRVSYAHGFKGLVYHADLSNDYDQVVVGAEYDFSKRTSALVSAGWLQEGKGAEKFVSTAGVVGLXHKF

SEQ ID NO: 22572 - protein, 318 aa, Neisseria gonorrhoeae
  misc_feature (38)..(38): Xaa can be any naturally occurring amino acid
  misc_feature (102)..(102): Xaa can be any naturally occurring amino acid
MKKSLIALTLAALPVAAMADVTLYGTIKAGVETSRSVXHNGGQVVSVETGTGIVDLGSKIGFKGQEDLGNGLKAIWQVEQKASIAGTDSGWGNRQSFIGLKXGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDKNVNIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKF

SEQ ID NO: 22573 - protein, 327 aa, Neisseria gonorrhoeae
MKKSLIALTLAALPVAAMADVTLYGTIKVGVETSRSVAYHGAQADRVKTTTEIADLGSKIGFKGQEDLGNGLKAIWQLEQKAYVSGTKEGWGSRQSFIGLKGGFGKVRVGHLNNILKDTGGFNPWEGKSYYLGLSNIAQPEERHVSVRYDSPEFAGFSGSVQYVPNDNSGKNHSESYHAGFNYKNSGFFVQYAGFYKRHNYTTEKHQVHRLVGGYDHDALYASVAVQQQDAKLTWRNDNSHNSQTEVATTVAYRFGNVTPRVSYAHGFKGSVYDADNDNTYDQVVVGAEYDFSKRTSALVSAGWLQRGKGTEKFVATVGGVGLRHKF

SEQ ID NO: 22574 - protein, 330 aa, Neisseria gonorrhoeae
MKKSLIALTLAALPVAAMADVTLYGTIKTGVETSRSVYYEDGKAAEVTTGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHEQIDNVKIEKYQIHRLVSGYDNDALHASVAVQQQDAKLVEDNYSHNSQTEVAATLAYRFGNVTPRVSYAHGFKGSFDDADRYNTYDQVVVGAEYDFSKRTSALVSAGWLQEGEGESKFVSTAGGVGLRHKF

SEQ ID NO: 22575 - protein, 327 aa, Neisseria gonorrhoeae
MKKSLIALTLAALPVAAMADVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTEKFVATVGGVVLRHKF

SEQ ID NO: 22576 - protein, 327 aa, Neisseria gonorrhoeae
MKKSLIALTLAALPVAAMADVTLYGTIKVGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTKKFVATVGGVGLRHKF

SEQ ID NO: 22577 - protein, 327 aa, Neisseria gonorrhoeae
MKKSLIALTLAALPVAAMADVTLYGTIKVGVETSRSVAYHGAQADRVKTATEIANLGSKIGFKGQEDLGNGLKAIWQLEQKAYVSGTLEGWGNRQSFIGLKGGFGKVRVGHLNSVLKDTGGFNPWEGKSYYLGLSNIAQPEERHVSVRYDSPEFAGFSGSVQYVPNDNSGKNLSESYHAGFNYKNSGFFVQYAGSYKRHNFTTEKHQVHRLVGGYDHDALYASVAVQQQDAKLTWRNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 22578 - protein, 326 aa, Neisseria gonorrhoeae
MKKSLIALALAALPVAAMADVTLYGTIKVGVETSRSVDHTGRANRVKTATEIADLGSKIGFKGQEDLGNGLKAIWQLEQKAYVSGTNEGWGNRQSFIGLKGGFGKVRVGRLNSVLKDTGGFNPWEGKSGYLSLSNIAEPEARHISVRYDSPEFAGFSGSVQYELNDNSNKYNSESYHAGFNYKNSGFFVQYAGAYKRHHYATEKHQVHRLVGGYDHDALYASVAVQQQDAKLALIDDNSHNSQTEVAATVAYRFGNVTPRVSYAHGFKGLVYHADLSNDYDQVVVGAEYDFSKRTSALVSAGWLQESKGAKKFLSTAGFVGLRHKF

SEQ ID NO: 22579 - protein, 331 aa, Neisseria gonorrhoeae
MKKSLIALTLAALPVAAMADVTLYGTIKAGVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGVGLRHKF

SEQ ID NO: 22580 - protein, 327 aa, Neisseria gonorrhoeae
MKKSLIALTLAALPVAAMADVTLYGTIKAGVETSRSVSHHEAQADRVKTATEIADLGSKIGFKGQEDLGNGLKAIWQLEQKAYVSGTLEGWGNRQSFIGLKGGFGKVRVGRLNSVLKDTGGFNPWEGKSYYLGLSNIAQPEERHVSVRYDSPEFAGFSGSVQYVPNDNSGKNHSESYHAGFNYKNSGFFVQYAGFYKRHSYTTEKHQVHRLVGGYDHDALYASVAVQQQDAKLTWRNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 22581 - protein, 327 aa, Neisseria gonorrhoeae
MKKSLIALTLAALPVAAMADVTLYGTIKAGVETSRSVSHHGAQADRVKTATEIADLGSKIGFKGQEDLGNGLKAIWQLEQKAYVSGTLEGWGNRQSFIGLKGGFGKVRVGRLNSVLKDTGGFNPWEGKSYYLGLSNIAQPEERHVSVRYDSPEFAGFSGSVQYVPNDNSGKNHSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 22582 - protein, 327 aa, Neisseria gonorrhoeae
MKKSLIALTLAALPVAAMADVTLYGTIKVGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATVAYRFGNVTPRVSYAHGFKGSVYDADNDNTYDQVVVGAEYDFSKRTSALVSAGWLQRGKGTEKFVATVVGVGLRHKF

SEQ ID NO: 22583 - protein, 326 aa, Neisseria gonorrhoeae
MKKSLIALTLAALPVAAMADVTLYGTIKAGVETSRSVAHHGAQADRVKTATEIADLGSKIGFKGQEDLGNGLKAIWQLEQKAYVSGTDTGWGNRQSFIGLKGGFGKVRVGRLNSVLKDTGGFNPWEGKSYYLGLSNIAQPEERHVSVRYDSPEFAGFRAVQYVPNDNSGKNHSESYHAGFNYKNSGFFVQYAGFYKRHSYTTEKHQVHRLVGGYDHDALYASVAVQQQDAKLTWRNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 22584 - protein, 327 aa, Neisseria gonorrhoeae
MKKSLIALTLAALPVAAMADVTLYGTIKAGVETSRSVAHHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 22585 - protein, 348 aa, Neisseria gonorrhoeae
MKKSLIALTLAALPVAATADVTLYGAIKAGVQTYRSVGHREGKVVSVETGSEISDFGSKIGFKGQEDLGNGLKAVWQLEQGASVAGTNTGWGNKQSFIGLKGGFGTIRVGSLNSPLKNTGVNVNAWESGKYTGEFLEISKMAEREHRYLSARYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYGTWHANSHNSQTEVAATAAYRFGNLTPRVSYAHGFKGSVRSADYDNTYDQVVVGAEYDFSKRTSALVSAGWLQEGKGADKIVSTASAVVLRHKF

SEQ ID NO: 22586 - protein, 348 aa, Neisseria gonorrhoeae
MKKSLIALTLAALPVAAMADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQTYSIPSLFVEKLQVHRLVGGYDNNALYVSVAAQQQDAKLYGAMSGNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 22587 - protein, 348 aa, Neisseria gonorrhoeae
MKKSLIALTLAALPVAATADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYRTWRANSHNSQTEVAATAAYRFGNLTPRVSYAHGFKGSVHSADYDNTYDQVVVGAEYDFSKRTSALVSAGWLQEGKGADKTVSTASAVVLRHKF

SEQ ID NO: 22588 - protein, 348 aa, Neisseria gonorrhoeae
MKKSLIALTLAALPVAAMADVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISRMAQREHRYLSVRYDSPEFAGFSGSVQYAPKDNSGSNGESYHVGLNYQNSGFFAQYAGLFQRYGEGTKKIEYDGQTYSIPNLFVEKLQVHRLVGGYDNNALYVSVAAQQQDAKLYGAMSGNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 22589 - protein, 348 aa, Neisseria gonorrhoeae
MKKSLIALTLAALPVAATADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKGNVNAWESGKFTGDVLEISGMAKREHRYLSVRYDSPEFAGFSGSVQYAPKDNSGSNGESYHVGLNYRNGGFFAQYAGLFQRYGEGTKKIEYDSQFYSVPSLFVEKLQVHRLVGGYDNNALYASVAAQQQDAKLYGTWRANSHNSQTEVAATVAYRFGNLTPRVSYAHGFKGSVHSADYDNTYDQVVVGAEYDFSKRTSALVSAGWLQAGKGADKIVSTASAVVLRHKF

SEQ ID NO: 22590 - protein, 348 aa, Neisseria gonorrhoeae
MKKSLIALTLAALPVAATADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 22591 - protein, 346 aa, Neisseria gonorrhoeae
MKKSLIALTLAALPVAATADVTLYGAIKAGVQTYRSVEHREGKVVGVETGSEISDFGSKIGFKGQEDLGNGLKAVWQLEQGASVAGTNTGWGNKQSFVGLKGGFGTIRAGSLNSPLKNTGDNVNAWESGKFTGNVLEISGMAKREHRYLSVRYDSPEFAGFSGSVQYAPKDNSGSNGESYHVGLNYQNSGFFAQYAGLFQRYGEGTKKMEEYLYNIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQRGKGADKIVSTASAVVLRHKF

SEQ ID NO: 22592 - protein, 344 aa, Neisseria gonorrhoeae
MKKSLIALTLAALPVAATADVTLYGAIKAGVQTYRSVEHREGKVVGVETGSEISDFGSKIGFKGQEDLGNGLKAVWQLEQGASVAGTNTGWGNKQSFVGLKGGFGTIRAGSLNSPLKNTGDNVNAWESGKFTGNVLEISGMAKREHRYLSVRYDSPEFAGFSGSVQYAPKDNSGSNGESYHVGLNYQNSGFFAQYAGLFQRYGEGTKKMEEYYIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQRGKGADKIVSTASAVVLRHKF

SEQ ID NO: 22593 - protein, 348 aa, Neisseria gonorrhoeae
MKKSLIALTLAALPVAAMADVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISRMAQREHRYLSVRYDSPEFAGFSGSVQYAPKDNSGSNGESYHVGLNYQNSGFFAQYAGLFQRYGEGTKKIEYDGQTYSIPSLFVEKLQVHRLVGGYDNNALYVSVAAQQQDAKLYGAMSGNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 22594 - protein, 346 aa, Neisseria gonorrhoeae
MKKSLIALTLAALPVAATADVTLYGAIKAGVQTYRSVEHREGKVVGVGTGSEISDFGSKIGFKGQEDLGNGLKAVWQLEQGASVAGTNTGWGNKQSFVGLKGGFGTIRAGSLNSPLKNTDDNVNAWESGKFTGNVLEISGMAKREHRYLSVRYDSPEFAGFSGSVQYAPKDNSGSNGESYHVGLNYQNSGFFAQYAGLFQRYGEGTKKMEGYLYNIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRHKF

SEQ ID NO: 22595 - protein, 348 aa, Neisseria gonorrhoeae
MKKSLIALTLAALPVAATADVTLYGAIKAGVQTYRSVEHREGKVVGVGTGSEISDFGSKIGFKGQEDLGNGLKAVWQLEQGASVAGANSGWGNKQSFVGLKGGFGTIRVGSLNSPLKNTDANVGAWESGKFTGNVLKISGMAQREHRYLSARYDSPEFAGFSGSVQYAPKDNSGSNGESYHVGLNYRNNGFFAQYAGLLQRYGEGTKKMEGHAYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEYDFSKRTSALVSAGWLQKGKGADKIVSTASAVVLRHKF

SEQ ID NO: 22596 - protein, 348 aa, Neisseria gonorrhoeae
MKKSLIALTLAALPVAATADVTLYGAIKAGVQTYRSVEHREGKVVGVETGSEISDFGSKIGFKGQEDLGNGLKAVWQLEQGASVAGTNTGWGNKQSFIGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDGQVYSMPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVSTASAVVLRHKF

SEQ ID NO: 22597 - protein, 185 aa, Wolbachia sp.
SYYVRLQYNGEILPFYTKVDGITNATGKEKDSPLTRSFIAGGGAFGYKMDDIRVDVEGLYSQLAKDTAVVNTSETNVADSLTAFSGLVNVYYDIATEDMPITPYVGVGVGAAYISNPSKTDAVKDQKGFGFAYQAKAGVSYDVTPEIKLFAGARYFGSYGASFDKAAKDDTGIKNVVYSTVGAEA

SEQ ID NO: 22598 - protein, 162 aa, Wolbachia sp.
SYYVRLQYNGEILPLFTKVEGITYKKDSSNYSPLKASFIAGGGSFGYKMDDIRVDVEGVYSYLNKNDVTGATFTPDTVADSLTAISGLVNVYYDVAIEDMPITPYIGVGVGAAYISTPLKEALNEQKNKFGFAYQAKAGVSYDVTPEIKLYAGARYFGSYGA

SEQ ID NO: 22599 - protein, 185 aa, Wolbachia sp.
SYYVRLQYNGEILPFYTTVDGITNATGKEKDSPLTISFIAGGGAFGYKMDDIRVDVEGLYSQLAKDTAVLNTSETNVADSLTAFSGLVNVYYDIAIEDMPITPYVGVGVGAAYISNPSKADAVKDQKRFGFAYQAKAGVSYDVTPEIKLFAGARYFGSYGASFDKAAKDDTGIKNVVYNTVGAEA

SEQ ID NO: 22600 - protein, 902 aa, Bordetella pertussis
MKPTISLFVGCLVAAASVSALADGSLSGQISSEAGGPQLEGAQIRIEELDRTTATDRNGRYRFPSLPAGQYTLTVDYLGAEPIARSITIGSADVVENVSLGGGDQEMELVMARGSASGINRALNRQRTANTITNVISSDAIGQFPDANTAEALSRVPGLSIERDQGEGRFVRVRGLGPAFNSVSINGTKIPAPEAGTRAVALDVVPSDLLQSLEVTKALTPDMDADSLGGAINVKSLSAFDQEDTYWKVSAEASQDGVVEKTSPKLAATYSDRFDLGDGADNLGIAAAISWYDRDFGSDNVETGGAWDFDSDPALLEELEQRDYSINRERLGAVFNLDYRASDRDQYYIRTLFSEFSDLETRQGNAIEFADAQAAGTRGDAEWARELKHREEVQNIHSIALGGEHKLEQWDLSYQAGFSEASEENNDAVDGAVFEADVANVGFSNTRRPQVLAPASAYQAGSFELAEVEVADTLAEDDEQSYRFDALRHFILGGHNGQLKMGVKTSLREKRNNEDIAVYEDLDQAGFSDAQLSLASYTQRSADYSLGQFGPEIDSTAIRQAISSLNRADYVDDEASAIADYRQEETINAAYTMASLNVGGMHWLTGLRYEDTQFEAEGNQVVDGNISTRSEKNDYDHILPALHMRYAFNDSTQVRAAFTQSIVRPSFEQLSPGVVIDQDEAEFGNPQLKAMESVNLDLGVEHYFGHAGVLSAFAFAKQIDHFIYQNDVAGSGRWASFSEAITFNNGGEADLTGIELAYSKQFRQLPAPWNGLLVSANATFSDSDADLGARKIPLPNQSDTTANLSIGYETQRFGVRLSNNYKSEYLIEVADLGDPNLDLYQAEHTQLDLSANYYPQSNMRVFVEVLNINDEPYYAYTGSKAYNAQYEEYDPTLRIGFSMTNF

SEQ ID NO: 22601 - protein, 390 aa, Neisseria meningitidis
MRKKLTALVLSALPLAAVADVSLYGEIKAGVEGRNYQLQLTEKPSSTNAKTGNKVEVTKAKSRIRTKINDFGSFIGFKGSEDLGDGLKAVWQLEQDVSVAGGGATRWGNRESFIGLAGEFGTLRAGRVANQFDDASQAIDPWDSNNDVASQLGIFKRHDDMPVSVRYDSPEFSGFSGSVQFVPIQNSKSAYTPAHVVVNNKVATHVPAVVGKPGSDVYYAGLNYKNGGFAGNYAFKYARHANVGRNAFELFLIGSATSDQAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAASVGLRHKF

SEQ ID NO: 22602 - protein, 955 aa, Salmonella typhimurium
MPTPQNYSFIAIAVSAALASMVFPSQAAWVDVDSLPSSGLVSQLPPELQAIIPAQASTGFTKVGTMPNYVYQWNTGTIPVYGNGLTLNGPGAEAFEHTVTVIQNSGTGSPGVIFGNDLTIRTQSANAANNGRDVDGIRTHGANTPDNPVFIITGDRTRIYVDGQDGDGINAGYNSLGQGWTGSANIYVGDDLYIKTTGSQGRGITANAMRDASRAKNTIVVGNRAHIVTTGDSSEGLRTGQSGSLIRLGDDATIETSGASSTGIYAASSSRTELGNNATITVNGASAHAVYATNATVNLGDNATISVNSASKAASYSKAPAGLYALSRGAINLAGGAAITMAGDNSSESYAISTETGGIVDGSSGGRFVIDGDIRAAGATAASGTLPQQNSTIKLNMTDNSRWDGASYITSATAGTGVISVQMSDATWNMTSSSTLTDLTLNSGAIIHFSHEDGEPWQTLTINEDYVGNGGKLVFNTVLNDDDSETDRLQVLGNTSGNTFVAVNNIGGAGAQTIEGIEIVNVAGNSNGTFEKASRIVAGAYDYNVVQKGKNWYLTSYIEPDEPIIPDPVDPVIPDPVIPDPVDPDPVDPVIPDPVIPDPVDPDPVDPEPVDPVIPDPVIPDIGQSDTPPITEHQFRPEVGSYLANNHAANTLFMTRLHDRLGETQYTDMLTGEKKVTSLWMRNVGAHTRFNDGSGQLKTRINSYVLQLGGDLAQWSTDGLDRWHIGAMAGYANSQNRTLSSVSDYHSRGQVTGYSVGLYGTWYANNIDRSGAYVDTWMLYNWFDNKVMGQDQAAEKYKSKGITASVEAGYSFRLGESAHQSYWLQPKAQVVWMGVQADDHREANGTLVKDDTAGNLLTRMGVKAYINGHNAIDNDKSREFQPFVEANWIHNTQPASVKMDDVSSDMRGTKNIGELKVGIEGQITPSLNVWGNVAQQVGDQGYSNTQGLLGVKYSF

SEQ ID NO: 22603 - protein, 270 aa, Chlamydia pneumoniae
MQPAKNLLFSSLLFSSLLFSSAARAASEDGGRGPYVQADLAYAAERITHDYPKPTGTGKNKISTVSDYFRNIRTHSVHPRVSVGYDFGSWRIAADYARYRKWNNNKYSVSIKELLRNDNSASGVRGHLNIQTQKTEHQENGTFHAVSSLGLSTIYDFDTGSRFKPYIGMRVAYGHVRHQVRSVEQETEIITTYPSNGGGKVSLSSKMPPKSAHHQSNSIRRVGLGVIAGVGFDITPNLTLDTGYRYHNWGRLENTRFKTHEASLGMRYRF

SEQ ID NO: 22604 - protein, 1110 aa, Chlamydia pneumoniae
MKDKLSIWWKFCLLTLLLVLAPPEIMAQGLTIKGQVLDSNNEPIIGASIVEKGNTSNGTITDFDGNFSFKISGKGKTIVITYIGYQTQELTVTSGKALKVIMKEDAQAMDEVVVIGYTSKARKDLTGSVGSVSGVKIAAIPVSSAAVALQGKIAGVQVTTVDGAPGADINIRVRGGTSVTQSNEPLYIVDGFQVDNINDIPPTDIASIDVLKDASITAIYGAKGGNGVVVVTTKSAKAGKIQVSLNAHLSTSQLAKKLDLMNAAEFARYQYEWSACNGSRSSNAKFFRANFGNPQDLDMYNTLPTHDWQDEVMGENPINYSTNVSIGGGTEKMRFNASLTQSEDKGIIMGSGVRRTNLNIKTAIDITKNLTLQINPKFSFRRDEGAGGDNIGTGGIIDVLRYRPTNGLREFGYIDPSYADPDEEALFTYTNPKSDISINQQKKYSYNYTNAFSLEWKPIKGLVLRSEATIGLTWKDQYRFYGALTSEGQKNNSQPVANIQKDYTFKYIWTNTASYGFTLKNVHNISLLLGQEIYHSQNTKNVQKNRYFPRAFEADQAWANMGFGTPQESYTQLSTPDRTASFFGQASYNYNHKYLLSLTMRADGSTKFAPGNQWGYFPSISGAWVLSEENFLNDVEWIDQLKLRAAFGLAGNNRIDNDMWRYLYSVNSTGGPGFGESTQFGEQWYGNQGNTTFANKDIKWETTLTRNLAADITLFGGRLTVTPEVYWNTTKDLLYKSDIPSSVGYISQMQNIGQVTNKGIELSISGDILRGRDYVLSANLSLGMNKMKVDKLNGTDNVIWDQNNRWKSSYNDYCLKVGDQVGLIYGFVYDGLYSMDEFYFDPTNNLQALPWGSTAAENGTSKDAPLVDENGVEHPKTVINEVSGNSNSGIATLPGKIKFKDLNGDGKITEDDRTVIGNTNPKVQGGFGVSGQWKNFDFAMNFNFMLDFDVNNATAYQLSSSEGNDKKFYNVLGTFADNGWRYTRDGDGECMYKCYFIDGSIDMYRQLNEGRTLWNPTDVTQKITHSYFIEDGSFVRCQDLTIGYTLPEKLTSKMGISKARFYVSASNLFIITGYSGYDPEVDIQTGLTCGMDYNRYPRSRSFVFGTNITF

SEQ ID NO: 22605 - protein, 540 aa, Chlamydia pneumoniae
MSLNINKNTKLLATAGLCAACWSGVATAQLATNLMVDPYALSLGNAVTAAPPGVASIHYNPAGLTKLKGRQLAVTLMGVHANIQSDFYAPEGYNVFGIDGVENDPIFDGDTVARSRTNTIALYVPGFGLQRLPKGPPALAPSVGFSLNPPGSKFTFANLTYGPEILGYYRKKDDPARYLGKALSLQRFTYLSPSFGYEINDEWSVGFGVSMSSQSLALDTYTRAPNLMIGVLEVLQDAFNCETGEEPLAPFLGLCGGNVGPWDDIGGMSIQVQETLSPKYHLGVLWEPTDWFAWGASYQSESDMKLKGTYELAYTDDWSGFWRSFNGSIVGAVTAGIFSLPSGTPREAGQLSIDLTHPQHFQTGVSVKLNHQFTVNVDVGWTDYSSWDSFLLKFDRNLEFLGAARLLSPNATANTMRLPLEYQDVWNLGVGVEHHLSSRLDLRFGVEMRNSPIPHNRRDILAPLNDTVLYSVGMGYKWDRDTTVDFNLSYMRSWQYIPAGSSLNLNDDGIQNIVYNPYAGVNVETNLKLIMAGMTFRTAF

SEQ ID NO: 22606 - protein, 1032 aa, Porphyromonas gingivalis
MKRMTLFFLCLLTSIGWAMAQNRTVKGTVISSEDNEPLIGANVVVVGNTTIGAATDLDGNFTLSVPANAKMLRVSYSGMTTKEVAIANVMKIVLDPDSKVLEQVVVLGYGTGQKLSTVSGSVAKVSSEKLAEKPVANIMDALQGQVAGMQVMTTSGDPNQVANVTIHGVGSLGAGTAPLYIVDGVATTLAVVAAMNPNDFESVTVLKDASATSIYGARAANGVVLIQTKRGKMSETGRVTFSASYGVSSIISKKPTENMMTGMEHLKYQMLSGLHGNALNNPNDPDQVDAVMKKYIQEAEDLFNQYPLLADGLKNNTLRPVDFSEDADWLKYFIRPTAPTTQVDATFSGGSTGTSYYVSLGYFDQEGISREPSLFKRYTTRFNLDSRINDWMKIGMNLSGSMANQKTSSFSGTNYYNTGTFGALSMPKFFNPFLISNGKHSDELAEAYFISGATRVFQSPERDYKWYPAEYTSFQAITTGYLQLNPIKGLTLKAQVGADIKDTRYTGKSLPNNPLAGTHLGSRTERFDGRRVYTSTNTAEYKFNVEDKHDVTLLLGHEFIDAELEWFRAQAKGYENADMMLLSQGKKGDNLILPAQQKEAYAYLSFFGRGSYGFDKWMYVDLSLRNDRSSRFGENNRSAMFYSAGAMFDIYNKFIQESNWLNDLRLKVSYGTTGNSEIGNYGHQAFVSAYNYTDDDLGLIINTAGNPDLSWETQAQFNVGVASAMFDNRLRAEVDFYVRSTKDMLIDVPMPYASGFFSQYQNVGSMRNTGIDIKLDGTIYQTKDWNVYASANFNFNKQKITELFHGLEEYVLPNTGTIWQVGKPNSFYMAEYAGIDHETGDMLWYVPGKYDADGNRVTTNKYSTELEVNVGKSVTPDITGGFSLGASWKGLALDADFAYIIGKWMINNDRYFIENGAPSGVKTNKSKILLDAWTETNKDTDVPRLGQTPQFDTHLLENASFLRLKNLKLSYALPNSLFAGQKVLSGARVYLMARNLFTVTKYKGFDPEAGGNVALNQFPNTKQFMGGIQLSF

SEQ ID NO: 22607 - protein, 1141 aa, Actinobacillus pleuropneumoniae
MRKISLNGLFCPKSLVFKQILRTMKITLFLLLFVTFQAYSHATYSQSARISIPRSELRVGEILDKIEAQTEYLFVYNKKSVDVRRTVNIDADNQPVSEVLDEIFNGTDIRYVMEGKNIVLTKQNEKASEIITAVQQENISVKGVVTDTKGEPIIGANVVEKGTTNGCITNIDGEFTLNTPTNATLVISFIGYQPVTIALNGQQTLNVQMQEEALSLETVVVTAMGIKKKAASLTYSTQQVGGDELTRAKDPNMINALAGKTAGVSITRNSSGLGGSAKVSIRGIRSANADGNNQPLYVIDGVPMLNNTSEQAFSAMGGNNDTGNRDSGDGISNLNPDDIESMSILKGASAAALYGSQAANGVILITTKKGKAGMQRITFSSNLTVDHAISLPEFQNRYGASGETSWGAENASMKAYDNVGDYFSNGVTATNSLSVTAGKEKMQTYFSYANTTASGIVDVNKLQKHNITFRETASLFNERLTLDANVNLMTQKIKNRPTSGGYYMNPLVGLYSFPRGEDMSVYRDNNGFERYDANRAMPLQNWYTDISGFTQNPYWLNNRVTSNDRRFRTMASLSANLKVNDWFTIQARGNVDYINDNYDQKMYAGTAADVAHENGRYIKLNRQEFMMYGDVMAMFNKTWNDWSLNAAIGSSINTTKVNSLSLDSGKSGLYKANVFTVANMNLGGAGTSFIDELNDQRRTIQSLFATAQIGWKESLYLDLTARNDWSSTLANTKSEGSGFFYPSVGVSWILNQTLNLPSWISFGKVRASWAQVGNDLPIGITSPAQTITAGGVVNPIDYYFAEDLKPEISTSIEFGTEWRFFNSRLDFDFTFYRTDTKNQLIRVNTTAEKRRFRWINAGKIRNTGIEVTVGATPLMNDNFRWKTQFNFATNKNEIVSLGGTPSFQYASGNVSMPYKMMVVEGGSLGDIYGNVFVRDESGKILLEPATDKDGNENKKAGLPQVTTDKAAKIGNFNPDWTLGWSNTLTYKGFSLYFLIDTRMGGDVISLTQAGLDYAGVSKATGDARAAKRYMLEGQEIKNVQGFYQMVGDRGNGTTEFYRYDGTNIRLRELSLGYSFPQQMLEKTGFIKGVDLSLVARNLFFIYKDAPFDPDATMSVGNDNQGLDTYGMPSTRNIGFNIKLTF

SEQ ID NO: 22608 - protein, 330 aa, Sphingomonas sp.
MTLGVQYRHEKIDYKQKSKSLVDDNSLSRWDFSVFGEDEFYVTDALTLLAGLRYNHDKDYGGHVAPRGYVVYHINDNFSLKGGVSAGYSTPNIDDRADGITIPINQGRGIRLGRSSLKPESSVNYEAGFSFDNNQNLKFSAMAFHTDFKDKIDDAVLCGGWGSGANFFNPSTWTCTYKGKTYFSIYEKVNVGKSEINGVELTADWDILSNLALHTNYTYTQSKQKSGSNEGKSLNDLPRHMLKTGLDYDFNKELNFWAQVDYIGKIKNGVNLSTNSYTLTDIGVNYKITKNASINFSVYNLFDKKLIDQKPVKAIVTDGRKFQLGFNVNF

SEQ ID NO: 22609 - protein, 352 aa, Neisseria meningitidis
GVEGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAAS

SEQ ID NO: 22610 - protein, 350 aa, Neisseria meningitidis
GVEGRNFQLQLTEPPSKSQPQVKVTKAQSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 22611 - protein, 351 aa, Neisseria meningitidis
GVEGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQQPTLVPAVVGKPGSDVYYAGLNYKNGGFAGNYAFKYAKHANVGRDAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 22612 - protein, 228 aa, Rickettsia prowazekii
MKKLLLIAATSATVLSSALSFADCGNDSWYLRVDAGAAMFNKEKDNQTGLKLKSNTAFTGDIGVGNYIAENFRADLTLGTTFSGKLKKSGAVSSLGGANISASHKPNITRLLINGYVDLSNFEMFDVFAGAGIGASMLKEKVSFSGINSGATVSTSYSSKNTTNLAYKLTLGASSQISDGVKAELAYSWISDGKTKGGNVNLFGLGNKQVKGTRYQSHNLTAGLRFDV

SEQ ID NO: 22613 - protein, 2331 aa, Rickettsia prowazekii
MKKSKILRKFLATASLCGTLFTNSNATGAIIPNSGSVSLNTGAGLVGGVFQNGDIIQIVNGGREIKISADKANAVIGGISALRELPDFGGVEVSQNVSIGPLSAGENLNTNFGPLKFISNNVTSIITGVDTQTFSNIDFAGKNATLQINKDLNITTKIDNTVAGNNGTITFEGSGVISNHIGFTNSLLGINVGNGEAKIDASRANNITINAKNINLTHNNSIFTLCDCNITTLKGNINNTTGIDGQGILNLAYDPDSSNIITGDICNIGSLDTINVLRGSATLNSTIVKATNINLQHDTATLNLGDNIIVIGNIKGINNEEERLNLKVNDQIDNEMIIPINKGMSGKLNLQGNATLNGNIDNLRILKFSGGHDKILNLQGNTEVEHIIFEDSILNSGTITVNGLLNTHVVTFNKSNANGGTLIINAKNTISASLLNAIKAKIQINANLTINHPSAGHIGDIRIADNTTYTINADIGHVNLLQNGAKIMFEGADAMLALINTSFTDRTFTIYNNLNQSGNDEYGIVKIEAITKGITISNHSEPYTIGQDNTHRLKELIVEGGGNIIVDNTVFTKLLSINSTGQITFNRTLDLGAGGNIAFGKNGTLVVHGVAGSITTSENNQGILTINSGNVTGTIGANGLGLKLVNIGAGSVTCSANVFAPVALTNPSSILILADGVTLTGTVTTHNNTKGILSLGIGSNVTGLIGENNATLEKINIGAGASNIDNNIYAGSMVLTDKTSELILNTNVVVNGNITTIAGNNSGKLVFTGNGDITGNIGANGAALQEVVFNGTTNIGGTANSQNFTVAHSEANVVITGLTTGSLKYKDTGTIIANGGLVGDIDFNNKAGKFILGDGTTIDGSVLCTGGIAGTLHFIGDGNVTQNIGSDTENSISTINIQGDNTKNVTITNDIFVNNIYFTNGGVLQLGGNLTTHNIDFGANGGTLEFNGNNTYNLNAIIVNGQNGILNAFTNLKATDDTIGTVKIINIGQIGTPQNFTIQVNNKNLTLVSNINSSINFCDSNSQLILSAPVDQTIKFINNLNGTGGGIITLDGNGNNLTISGNNGIKLGSRDNELSSLNIKGKVTVTHNLDVQNIHQLNINNGAFFNDHSLTSAKIKNINIGEETGEATYTLDAINCDFDLNTSGMVFKHQDSVLELKNSSNTNDRIITLTSVLDPGNGQSGIIKLITDTNKLTIDNNGNVAYTLGTANHMLKQLTFTSINNGAIALKVGINVENITLNIKDIELNEVNANVLFNKNVTYTATGNINGHVDFQGNAGVINLDDGIKIDGSVTSTNDVNGTLNLNGSGEVTGLITNIAMLQAGAGDVSLSASGNYSITEIQGNGNNNLTFAANSHLTTDINKTDGQAVNLVFINGGSVSGSVGLSKAVGDIIIHAGNVTFNNTVKSSNVVISDGSTMQVNNNITANDISGKNINNGTLKLNNHTPIIITSTLGHNNSIGTIEVANNDVTITGALKAQNIHFSNAAQETTLTLGAASQVTNITTAGNNIHTLEITDLDTGNDGTIGTENNRLKSIELTGNGTITINSKHVYSSITTANNEQGNVKLNIEGGIAYDLGSEIRSLANVQISEDSTVKGDVYSKYLNIDAGKTINFDRGDNNMNPKNLDIPDAIIDLDVLPRSLSLFNYFTDIKADNLNFVDGTATANFKDAVVIDARIDNGGTLKFNNNVWLTQEIKNANSIEIASNKFMLLQKNIKAATLIADKANLVLLDNVEINTNLNVRDIVLDLANYELKYTGNVTHNGLLTIITYFDTALQKGGHILVGQGSNVDMSDLDNLIIKIKSRSDITNITSDTKHQVVKLEAGAIYNPVPQTKVIIDASGEQNKFVKWVTDANGFVLLTNTDTIGQNNTDNGSLDNGYVGNSSNNNSSNGVVGPSKDKDHGITDIAPIFDPSPILDYTKNNYVASSIANQLINHVKGFGNTTDAGKLLNDLGFMLPNRVTETLDRLSHRTNINGLNEGVAGLNGIEIENFLTDIAINMDNFTAEGIGNRLEELIDAGTVNGLNRTNASLNNNNLNLRRLAANNQTVIAAGDEDNTVTGIWGMSFYSKIKQNSKNSASGYQSNTGGGIIGFDYNIDNSIVIGAAYTMADSKVKHKNDKSGDKTKAKSNIYSIYGLYHWLNNNFFVEAIGVYGRNKIKNYEKRITAITDQTAIGKFINTFYSYELLGGYNYLVSNRTTITPMFGIRYTTLKNNSYKENNTTFQNLSIKKNYHDKFETILGLNGATHYLAQDIIIKPELHWFINYQYKNKLPNIDARLDGIDEPLTTIRFKSAKITYNLGGGISTKNNMIEFGIRYNLSLAKKYTAHQGSLKIKVKL

SEQ ID NO: 22614 - protein, 983 aa, Rickettsia prowazekii
MDVRIKPISVGTLLLVISATQAQAQYLETGKPGDPASWRSAEFLRDWGLDRMQADQAYAAGITGKGVKIGALDSGFDAAHPEFAHDRYHPVLASGSYIDGSLFNVNGTLNPNNDSHGTHVVGTMGASRDGTGMHGVAYNAQIYVGNTNKNDSFLFGPNPDPRYFKAVYDALADAGVRAINNSWGSQPPDVSYRTLADLHAAYAQHWNKGTWLDAAAEVSRRGVINVFSAGNSGYPNASVRSALPYFQPDLEGHWLAVSGLDQSNQQKYNQCGIAKYWCITTPGAKIDSTIPDGGYAIKSGTSMAAPHATGALALVMERYPYMNNQQALEVLLTTATQLDGSVTDAPTERVGWGVANLYRAMRGPGQLLGAFDAHLAAGQSDVWSNDISDKALIQRQSEDLAEHNAWQQTLQNRGWQNGVPAGASQQDQTDYAVGMARDAAAAGRVYQGSLIKSGDGRLILTGENTYRGPTTVNGGLLTVNGSLTSTVTVNDGGTLGGSGRIGALTANSGGRVAPGNSIGTLNVAGDVTFASGSTYAVELSPTSSDRIVAGGTASINGATVSLSLENSPTLLSTTEARSLLGQQYDILQAAGGIQGRFGAVLPDYLFIGGSLAYSDNGIGLNVERNATSLASVGQTPNQRSVATAVEGLGAGSSVYESLLLSATASDAQQAFQQLSGEIYPALGSVLINDSRQLRDAIGERLHDTQATQSNGWIKALGAWGTTDSRHDTAGYSTSIGGLLAGVDGAVDEQTRIGLVTGYSDSSLSMGSGTHSSAKVDSYHLGAYAGHEIGAWRLSTGAAYSWHRADVKRDLQYGNVSAKQKAKVDAATTQVFGEAAYRLNLQPLALEPFANLAYVHLDTDGFTEKGDAAALKSGDDQRDAVLSTLGVRAIKTFDLPSAQKLEVSGHLGWQHSLTDIDSEQHLRFASGSAPYTVESSPLVRDAALVGVQASLALARDVRVNLDYTGQLASREKQHGVGLSLNWQF

SEQ ID NO: 22615 - protein, 330 aa, Rickettsia prowazekii
MNKVAIAVAAVVAGSSALLNSAQAEMYIGGKVGMTTLDDACYLNSPCDDEAFGAGLHIGYDFTDIIGLEYGVDFLGDYKANFKSGANTVNTIDGNLTALTLAPKFNWHLNESWNLFAKIGGAYMMSDDEKDFVPTGSLGAEYTIDRNWSVRAEYQRYQDLSDDVWDDMDANFFGIGFNYKFAAAPVVAAVVTEEVVEPDPEPVMMSKVHKEEYGTGTFEFDSAKLTESVSERLDNFVSFLNEYPQAQVEITGYTDSSGPATYNQKLSERRAQSVADYLTAAGIDSDRLTVKGMGEENPVADNSTREGREKNRRVEVVVPSFEYQELVQPE

SEQ ID NO: 22616 - protein, 619 aa, Neisseria meningitidis
MFRAQLGSNTRSTKIGDDADFSFSDKPKPGTSHYFSSGKTDQNSSEYGYDEINIQGKNYNSGILAVDNMPVVKKYITDTYGDNLKDAVKKQLQDLYKTRPEAWEENKKRTEEAYIEQLGPKFSILKQKNPDLINKLVEDSVLTPHSNTSQTSLNNIFNKKLHVKIENKSHVAGQVLELTKMTLKDSLWEPRRHSDIHMLETSDNARIRLNTKDEKLTVHKAYQGGADFLFGYDVRESDKPALTFEEKVSGQSGVVLERRPENLKTLDGRKLIAAEKADSNSFAFKQNYRQGLYELLLKQCEGGFCLGVQRLAIPEAEAVLYAQQAYAANTLFGLRAADRGDDVYAADPSRQKLWLRFIGGRSHQNIRGGAAADGRRKGVQIGGEVFVRQNEGSRLAIGVMGGRAGQHASVNGKGGAAGSYLHGYGGGVYAAWHQLRDKQTGAYLDGWLQYQRFKHRINDENRAERYKTKGWTASVEGGYNALVAEGVVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 22617 - protein, 360 aa, Francisella philomiragia
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 22618 - protein, 393 aa, Francisella tularensis
MMRLKSIVIATTVLLGSATASIAAGSDNIDTSANTNSATTQSSGFAANNFIAPFANTYSALTNKDNTWGPQDRTGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTVNGDEVTVYLDTKFAYDKATLNAKGKKAIASFVNFIKDSNISSVTVKGYASQGQTGSEFDIYNQKLSEKRAQAVADYMKQLGLDSEKIITKGFGYNDTLGGIHKSDPRNQRVEASVSAPLKEAN

SEQ ID NO: 22619 - protein, 453 aa, Ehrlichia canis
MKYKIVTPYTLAMVAIIVSTTLRVSYATDVFRLEGFGPVSRGMGGAATAFDVGAAGMMTNPATLSLMGAGSEIHVGLDVVVTDISAKNKATGENASSDSHSNNRGPYAAPEAGFVYRAAPLTLGFGAFAQGGLGTEYGRNTFLSRASGNLDTGLDNSSRLLVLNVPFAITYDINEKLTIGAAIDAMWEGLNLELLLPAEDVGALIQGGRVTGSLLPVLGGLPDLRGAHFSMTKNQPIASGIDAWGFGARIGGVYKLSKDTIIGAAYTMESRMADMEGNATMTAVDGSAGQIPLKGKIKLGGLQMPAQLDIGVSHQINEHWLVVADISRVFWKNAVKDLKVHFVTDNGEDIHISLPQNYKDQMIYSLGVAYRTGHWTLRCGGRIASQAMRSDTVIAVIPAIPTKHASAGFSYDFSAANTVDFAYSHAFEESFDNANTRLVHSQNNFSIAYTHRF

SEQ ID NO: 22620 - protein, 185 aa, Wolbachia sp. wKayLC
SYYVRLQYNGEILPFYTKVDGIKNATSKEKDSPLKRSFIAGGVAFGYKMDDIRVDVEGLYSRLAKNKAVIDASEANVADSLTAFSGLVNVYYDIVIEDMPITPYVGVGVGAAYISNPSNAADVKDQRRFGFAYQAKAGVSYDVAPEIKLFAGARYFGSYGASFDKAAKGDDGIKNILYNTFGAEA

SEQ ID NO: 22621 - protein, 185 aa, Wolbachia sp. wKayB
SYYVRLQYNGEILPFYTKVDGIKNATSKEKDSPLKRSFIAGGVAFGYKMDDIRVDVEGLYSRLAKNKAVIDASEANVADSLTAFSGLVNVYYDIVIEDMPITPYVGVGVGAAYISNPSNAADVKDQRRFGFAYQAKAGVSYDVAPEIKLFAGARYFGSYGASFDKAAKGDDGIENILYNTFGAEA

SEQ ID NO: 22622 - protein, 185 aa, Wolbachia sp. wSib
SYYVRLQYNGEILPFYTKVNGIKNAANKDKDSTLKRSFIAGGVAFGYKMDDIRVDVEGLYSRLAKNGDVIDASEASVAESLTAFSGLVNVYYDIVVEDMPIIPYVGVGVGAAYISNPSKVAEVKDQRSFGFAYQAKGGVSYDVTPEIKLFAGARYFGSYGASFDKTTKGDDGIKNVVYNTFGAEA

SEQ ID NO: 22623 - protein, 184 aa, Wolbachia sp. wSta
SYYVRLQYNGEVLPFKTKIDGVTHKSGKDNNSPLKASFLAGGGAFGYKMDDIRVDVEGLYSQLSKDADVAADSPAIAESLTAFSGLVNVYYDIAIEDMPITPYVGVGVGAAYVSNPLVTKVTGDKKSGFGFAYQAKAGVSYDVTPEIKLYAGARYFGSYGANFGKTAKDDGGIKVLYSTVGAEA

SEQ ID NO: 22624 - protein, 183 aa, Wolbachia sp. wFor
SYYVRLQYNGEILPFKTKITGITHKSGKDKDSPLKASFLAGGGAFGYKMDDIRVDVEGLYSQLSKDGDVADDPEIAESLTAFSGLVNVYYDVAIEDMPVTPYIGVGVGAAYVSNPLATKVTDDKASGFAFAYQAKAGVSYDVTPEIKLYAGARYFGSYGANFGKTSKDDAGIKVLYSTVGAEA

SEQ ID NO: 22625 - protein, 185 aa, Wolbachia sp. wVul
SYYVRLQYNGEVLPFKTKIDGIEYKKGDDAQDPLKASFMAGSGAIGYKMDDIRVDAEVLYSQLNKSDLKGATFTPETVADNVTAFSGLVNVYYDVAIEDMPITPYVGVGVGASYLSNPSKADAVKDQKGFAFAYQAKAGVSYDVTPEIKLFAGARYFGSYGASFDKTAKDDAGIKVFYSTIGAEA

SEQ ID NO: 22626 - protein, 163 aa, Wolbachia sp. wDiv
SYYVRLQYKGEFLPLFTKVDGITYKKDKSDYSPLKPSFIAGGGAFGYKMDDIRVDVEGVYSYLNQNDVKDVTFDPANTIADSVTAISGLVNMYYDIAIEDMPITPYIGVGVGAAYISTPLEPAVNDQKNKFGFAGQVKAGVSYDVTPEVKLYAGARYFGSFGA

SEQ ID NO: 22627 - protein, 185 aa, Wolbachia sp. wBed
  misc_feature (117)..(117): Xaa can be any naturally occurring amino acid
SYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNXSKADAVKDQKGFGFAYQAKAGVSYDVTPEIKLFAGARYFGSYGASFDKAAKDDTGIKNVVYSTVGAEA

SEQ ID NO: 22628 - protein, 162 aa, Wolbachia sp. wPer
SYYVRLQYNGEILPLFTKVDGITYKKGNSDYSPLKASFIAGGGAFGYKMDDIRVDVEGVYSYLNKNDVTDAKFTPDTIADSLTAISGLVNVYYDIAIEDMPITPYIGVGVGAAYISTPLATAVSSQNDKFAFAGQARAGVSYDVTPEVKLYAGARYFGSYGA

SEQ ID NO: 22629 - protein, 187 aa, Wolbachia sp. wKue
SYYIRLQYNGEILPLFTKVDGITYKKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGYTVLYSTVGAEA

SEQ ID NO: 22630 - protein, 191 aa, Wolbachia sp. wDro
SYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSYGANFDGKKTDPIDSTKQVTDAGAYKVLYSTVGAEA

SEQ ID NO: 22631 - protein, 188 aa, Wolbachia sp. wFus
  misc_feature (34)..(34): Xaa can be any naturally occurring amino acid
SYYVRLQYNGEFLPLFTKVDGATGAKKTADTATXTDLYKASFMAGGGAFGYKMDDIRVDVEGLYSQLSKDALAVAPTPAIADSLTAISGLVNVYYDIAIEDMPITPYIGVGVGAAYISTPLATAVSSQNGKFAFAGQARAGVSYDVTPEVKLYAGARYFGSYGANFDKTDKDGKGKLKVLYSTVGAEA

SEQ ID NO: 22632 - protein, 296 aa, Neisseria meningitidis
GVETSRFVAHNGAQAASVETGTGIVDLGSKIGFKGQEDLGNGLKAIWQVEQKASIVGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEDLNIEKYQIHRLVSGYDNDALYASVAVQQQDAKLALPNDNSHNSQTEVAATLAYRFGNVTPRVSYAHGFKGSFDDADLSNDYDQVVVGAEYDFSKRTSALVSAGWLQEGKGENKFVSTAGG

SEQ ID NO: 22633 - protein, 1289 aa, Helicobacter pylori
MEIQQTHRKINRPLVSLALVGALVSITPQQSHAAFFTTVIIPAIVGGIATGAAVGTVSGLLSWGLKQAEEANKTPDKPDKVWRIQAGRGFNEFPNKEYDLYKSLLSSKIDGGWDWGNAARHYWVKDGQWNKLEVDMKDAVGTYNLSGLINFTGGDLDVNMQKATLRLGQFNGNSFTSFKDGANRTTRVDFNAKNILIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTTSQSGAKNDKNENAKNDKQDSNTQVINPPNSGQKTEIQPTQVIDGPFAGAKDTVVNINRINTNADGTIKVGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGNQSRINTVRLETGTRSIYSGGVKFKGGEKLVINDFYYAPWNYFDARNIKNVEITNKLAFGPQGSPWGTSKLMFNNLTLGPNAAMDYSQFSNVTIQGNFINNQGTINYLVRGGNIETLSVGNAAVMSFNNDIDSATGFYKPIIKINSAQDLIKNKEHVLLKAKIIGYENASLGTNSISNANLIEQFNERLALYNNNNRMDTCVVRNTDDIKACGMAIGNQAMVNNPDNYKYLIGKAWKNIGISKTANGSKISVRYLGNATPADPTDLPKNAENSAEKPLNNALLARSAFSTQPNATPSLVAINKHNFGTIESVFELANRSKDIDTLYANSGAQGRDLLQTLLIDSHDAGYARTMIDTTSTNEITKQLNEANSALNNIASLEHKTNGLQTLSLSNAMILNSRLVNLSRRHTNNIDSFAKRLQALKDQRFASLESAAEVLYQFAPKYEKPTNVWANAIGGASLNSGGNTSLYGTSAGVDAYLNGEVEAIVGGFGSYGYSSFNNQANSLNSGANNANFGVYSRIFANQHEFDFEAQGAVGSDQSSLNFKSALLRDLNQSYNYLAYGASTRASYGYDFAFFRNALVLKPSVGVSYNHLGSTNFESNSTHKTALKNGASSQHLFNASANVEARYYYGDTSYFYMNAGVLQEFANFGSSNAVSLNTFKVNATRNPLNTHARVMMGGELKLAKEVFLNLGFVYLHNLISNIGHFASNLGMRYSF

SEQ ID NO: 22634 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTNSQSGAKSDKNESAKNDKQDSNTQVINPPNSGQKTEIQPTQVIDGPFAGAKDTVVNINRINTNADGTIRVGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSHINTVRLETGTRSIYSGGVKFKGGEKLVINDFYYAPWNYFDARNIKNVEITNKLAFGPQGSPWGTAKLMYNNLTVGHNAVMDYSQFSNVTIQGNFVNNQGTINYLVRGGNIETLSVGYAAVMSFNNDIDSATGFYKPLIKINNAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNSTPTDNGGNTTNLPTNTTNNARFARYALIKNAPFAQTNATPNLVAINKHDFGTIESVFELANRSKDIDTLYAHSGVQGRDLLQTLLIDSHNAGYARTMIDATSANEITKQLNTATDALNNIASLEHKTSGLQTLSLSNAMILNSRLVNLSRRHTNNIDSFAKRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLIPSVGVSYNHLGSTNFESNSTNKTALKNGASSQHLFNASANVEARYYYGDTSYFYMNAGVLQEFANFGSSNAVSLNTFKVNTARNPLNTHARVMMGGELKLAKEVFLNLGFIYLHNLISNAGYFASNLGMRYSF

SEQ ID NO: 22635 - protein, 1328 aa, Helicobacter pylori
MELQQTHRKINRPLVSLALVGLLVSITPQKSHAAFFTTVIIPAIVGGIASGAAVGTVSGLLGWGLKQAEEANKTPDKPDKVWRIQAESFNEFPNKEYDLYKSLLSSKIDGGWDWGNAARHYWVKGGQWNKLEVDMKDAVGTYKLSGLKNFTGGDLNVNMQKATLRLGQFNGNSFTSFKDSADRTTRVDFQNAKNISIDNFLEINNRVGSGAGRKASSTVLTLQASEGITSDKNAEISLYDGATLNLASNSVKLMGNVWMGRLQYVGAYLAPSYSTINTSKVVGEVNFNHLTVGDHNAAQAGIIASKKTYIGTLDLWQSAGLNIIAPPEGGYKDKPNNTNSQSGAKNDKNESAKNDKQESSPNNSNTQVINPPNSGQKTEIQPTQVIDGPFAGAQDTKVNINRINTNADGTIKVGGYTASLTTNAANLNIGKGGVNLSNQASGRSLLVENLTGNITVDGALMVNKEAGGAALPGSSANFEFKAGVDTKNGTATFNNDIRLGKAVNLKVDAHTINFNGNMYLGRFTHLKVNGHTANFKNIDASKGRNGIDTTILDFSGVTNKVNINKLITASTNVAIKNFDIKELVVTTNGLSVGKYTDFTEDIGDQSPIGIVRLGKGYSPLYAGGVRFKSGKKLVIDEIYHAPWNYFGTLGITDVEITKRILFGAPGNIAGKTGLMFNNLTLNSNASMDYGKDLDLTIQGHFTNNQGTMNLFVQDGRVATLNAGHQASMIFNNLVDSTTGFYKPLIKINNAQNLTKNKEHVLVRARNIDYNLVGVQGASYDNIFASNTNLMEQFKERLALYNNNNRMDICVVRKDNLNDIKACGMAIGNQAMVNNPENYKYLEGKAWKNTGINKTANNTTIAVNVGNNSTPTSSESNTTNLPTNATKNARFARYALIKNAPFAHYSATPNLVAINKHDFGTIESVFELANRSDDIDTLYAHSGAQGRDLLQTLLIDSHNAGYARTMIDATSANEITKQLNTATDALNNIASLEHKTSGLQTLSLSNAMILNSRLVNLSRRHTNNIDSFARRLQALKDQKFASLESAAEVLYQFAPKYEKPTNVWANAIGGASLNSGGNTSLYGTSAGVDAYLNEKVKAIVGGFGSYGYSSFNNQANSLNSGANNANFGVYSRIFANRHEFDFEAQGALGSDQSSLNFKSALLRDLNQSYNYLAYGAATRASYGYDFAFFRNALVLKPSVGVSYNHLGSTNFESNSTHKTALKNGASSQHLFNASANVEARYYYGDTSYFYMNAGVLQEFANFGSSNAVSLNTFKVNAVRNPLNTHARVMMGGELQLAKEVFLNLGFIYLHNLISNAGHFASNLGMRYSF

SEQ ID NO: 22636 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKSDKNESAKNDKQDSNTQVINPPNSGQKTEIQPTQVIDGPFAGAKDTVVNINRINTNADGTIKVGGYTASLTTNAAHLNIGKGGVNLSNQASGRSLLVENLTGNITVDGALMVNNQVGGYALAGSSANFEFKAGVDTKNGTIAFNNNISLGRLVNLKASAHTVNFKDIDTGNGGFNTLDFSGVTNKVNINKLITASTNVAIKNFNINELLVKTNGISVGEYTNFSEDIGNQSHINTVRLETGTRSIYSGGVKFKGGEKLVINDFYYAPWNYFDARNIKNVEITNKLAFGPQGSPWGTAKLMFNNLTLGLNAVMDYSQFSNVTIQGNFVNNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNSTPTDNGGNTTNLPTNTTNNARFARYALIKNAPFAQTSATPSLVAINKHDFGTIESVFELANRSKDIDTLYAHSGVQGRDLLQTLLIDSHNAGYARTMIDATSANEITKQLNTATDALNNIASLEHKTSGLQTLSLSNAMILNSRLVNLSRRHTNNIDSFAKRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNALSLNTFKVNAARNPLNTHARVMMGGELKLAKEVFLNLGFIYLHNLISNAGYFASNLGMRYSF

SEQ ID NO: 22637 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLKNFTGGDLNVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAQDTVVNINRINTNADGTIKVGGYTASLTTNAAHLHIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIKTLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNTTNNARFARYALIKNAPFAQTNATPNLVAINKHDFGTIESVFELANRSKDIDTLYAHSGAQGRDLLQTLLIDSHDAGYARTMIDATSANEITKQLNTATDALNNIASLEHKTSGLQTLSLSNAMILNSRLVNLSRRHTNNIDSFAKRLQALKDQRFASLESAAEVLYQFAPKYEKPTNVWANAIGGASLSSGGNTSLYGTSAGVDAYLNEKVEAIVGGFGSYGYSSFNNQANSLNSGANNANFGVYSRIFANRHEFDFEAQGALGSDQSSLNFKSALLRDLNQSYNYLAYGAATRASYGYDFAFFRNALVLKPSVGVSYNHLGSTNFESNSTHKTALKNGASSQHLFNASANVEARYYYGDTSYFYMNAGVLQEFANFGSSNAVSLNTFKVNAARNPLNTHARVMMGGELQLAKEVFLNLGFIYLHNLISNAGHFASNLGMRYSF

SEQ ID NO: 22638 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKSDKNESAKNDKQDSNTQVINPPNSGQKTEIQPTQVIDGPFAGAKDTVVNINRINTNADGTIRVGGYTASLTTNAANLNIGKGGVNLSNQASGRSLLVENLTGNITVEGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNATNNARFASYALIKNAPFAQTNATPNLVAINKHDFGTIESVFELANRSKDIDTLHAHSGAQGRDLLQTLLIDSHDAGYARTMIDATSANEITKQLNTATDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELKLAKEVFLNLGFVYLHNLISNIGHFASNLGMRYSF

SEQ ID NO: 22639 - protein, 1303 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNNFPNKEYDLYKSLLSSKIDGGWDWGNAARHYWVKGGQWNKLEVDMKDAVGTYKLSGLRNYTGGDLDVNMQKATLRLGQFNGNSFTSFKDGANRTTRVDFNAKNISIDNFLEINNRVGSGAGRKASSTVLTLQASEGITSNKNAEISLYDGATLNLVSSSNHSVDLYGKVWMGRLQYVGAYLAPSYSTINTSKVVGEMNFRHLAVGDQNAAQAGIIANKKTNIGVLDLWQSAGLNIIAPPEGGYESKNKDNPQNNPKNDTQKTETEPTQVIDGPFAGAKDTVVNIFRLNTNADGTIRVGGFKASLTTNAAHLHIGEGGVNLSNQASGRSLLVENLTGNITVEGALRVNNQVGGSAVAGSSANFEFKAGKDTNNGTATFNNDIHLGKAVNLRVDAHTAYFNGNIYLGKSTNLKVNGHNAHFKNIDASKSDNGLNTSTLDLSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNKARFASYALIKNAPFARYSATPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNHIDSFAQRLQALKGQRFASLESAAEVLYQFAPKYEKPTNVWANAIGGTSLNNGSNASLYGTSAGVDAYLNGEVQAIVGGFGSYGYSSFSNQANSLNSGANNTNFGVYSRLFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANIEARYYYGDTSYFYMNAGVLQEFARFGSNNAASLNTFKVNATRNPLNTHARVMMGGELQLAKEVFLNLGVVYLHNLISNASHFASNLGMRYSF

SEQ ID NO: 22640 - protein, 411 aa, Helicobacter pylori
MELPPSVIVNAASAFLYLRRFSSQPTRRSPSVKKPLLAGATAAALFAPLAHAQRSVTLYGLIDAGLMYTNNAGGASQWRATSGTINGSRFGLRGVEDLGGGIKALFLLENGFNANNGTLGQDGKIFGRHAYMGLSGNGYGTLTLGRQYDTMVDFVAPLSASAGDFGDTDFAHPFDNDNLNHSLRIDNAVKYTSDHYAGVKFGALYGFSNAANFADNRAYSLAASYGNGPLKLAGAYLQIDGSKGTTGASPGAVDAVEAKGLSQGGWLTGSKRMRSYGGGVNYTLGSAVVGFVYTRSRYDDSGSFGSTGEIRFDNYEANLRYAITPAFGVGGAYVYTGGHVSASDSRHDAAPAWQQVDLQAVYKLSRVTDIYAEAMHQHASGRGYRAFINGSGGASGTPNQIVCTVGMRTRF

SEQ ID NO: 22641 - protein, 1291 aa, Helicobacter pylori
MELQQTHRKINRPLVSLALVGLLVSITPQKSHAAFFTTVIIPAIVGGIATGTAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFHAKNILIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAAHLNIGKGGINLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKSGEKLVINDFYYAPWNYFDARNIKNVEITNKLAFGPQGSPWGTAKLMFNNLTLGPNAVMDYSQFSNVTIQGNFVNNQGTINYLVRGGNIETLSVGNAAVMSFNNDIDSATGFYKPLIKINSAQDLIKNKEHVLLKAKTIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNTTNNARFASYALIKNAPFAQTSATPNLVAINKHDFGTIESVFELANRSSDIDTLYAHSGTQGRDLLQTLLIDSHNAGYARTMIDATSANEITKQLNTATDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANQHEFDFEAQGALGSDQSSLNFRSALLRDLNQSYNYLAYSAATRASYGYDFVFLRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELQLAKEVFLNLGFVYLHNLISNIGHFASNLGMRYSF

SEQ ID NO: 22642 - protein, 1296 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSSKNAEISLYDGATLNLASNSVKLMGNVWMGRLQYVGAYLAPSYSTINTSKVTGEVDFNHLTVGDHNAAQAGIIASKKTNIGTLDLWQSAGLNIIAPPEGGYKDKPNNTNSQSGAKNDKNESAKNDKQESSQNNSNTQVINPPNSGQKTEIQPTQVIDGPFAGAKDTVVNINRINTNADGTIKVGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFSINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLSVGNAAAMLFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPENYKYLIGKAWKNIGISKTANGSKISVRYLGNATPAENGGNTTNLPTNTTNNARFARYALIKNAPFAHYSATPNLVAINKHNFGTIESVFELANRSEDIDTLYAHSGAQGRDLLQTLLIDSHNAGYARTMIDATSANEITKQLNTATDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTHKTALKNGASSQHLFNASANVEARYYYGDTSYFYMNAGVLQEFANFGSSNAVSLNTFKVNVARNPLNTHARVMMGGELKLAKEVFLNLGFIYLHNLISNAGHFASNLGMRYSF

SEQ ID NO: 22643 - protein, 1296 aa, Helicobacter pylori
MELQQTHRKINRPLVSLALVGLLVSITPQQSHAAFFTTVIIPAIVGGIASGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFNAHNILIDNFLEINNRVGSGAGRKASSTILTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESAKNDKQESSQNNSNTQVINPPNSGQKTEIQPTQVIDGPFAGAKDTVVNINRINTNADGTIRVGGYTASLTTNAAHLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKIVEITNKLAFGPQGSPWGTSKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNATNNARFARYALIKNAPFAQTSATPNLVAINKHNFGTIESVFELANRSKDIDTLYANSGVQGRDLLQTLLIDSHDAGYARTMIDATSANEITKQLNTATDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFSNQANSLNSGANNANFGVYSRIFANRHEFDFEAQGAVGSDQSSLNFKSALLRDLNQSYNYLAYGASTRASYGYDFAFFRNALVLKPSVGVSYNHLGSTNFESNSTHKTALKDGASSQHLFNASANVETRYYYGDTSYFYMNAGVLQEFANFGSSNAVSLNTFKVNTARNPLNTHARVMIGGELQLAKEVFLNLGFIYLHNLISNAGYFASNLGMRYSF

SEQ ID NO: 22644 - protein, 1296 aa, Helicobacter pylori
MELQQTHRKINRPLVSLALVGALVSITPQQSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFNAKNISIDNFLEINNRVGSGAGRKASSTVLTLQASEGITSDKNAEISLYDGATLNLASNSVKLMGNVWMGRLQYVGAYLAPSYSTINTSKVAGEVNFNHLTVGDRNAAQAGIIASKKTYIGTLDLWQSAGLNIIAPPEGGYKDKPNNTNSQSGAKNDKNESAKNDKQESSQNNSNTQVINPPNSGQKTEIQPTQVIDGPFAGAKDTVVNINRINTNADGTIKVGGYTASLTTNAAHLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGNQSRINTVRLETGTRSIYSGGVKFKGGEKLVINDFYYAPWNYFDARNIKNVEITNKLAFGPQGSPWGTSKLMFNNLTLGPNAVMDYSQFSNVTIQGNFINNQGTINYLVRGGNIETLNVGNAAVMSFNNDIDSATGFYKPLIKINSAQDLIKNKEHVLLKAKIIGYDNVSLGTNSISNANLIEQFNERLALYNNNNRMDTCVVRNTDDIKACGMAIGDQAMVNNPDNYKYLIGKAWKNIGISKTANGSKISVRYLGNATPAENGGNTTNFTYNTTNNARFASYALIKNAPFAQTNATPNLVAINKHNFGTIESVFELANRSKDIDTLYAHSGAQGRDLLQTLLIDSHNAGYARTMIDATSANEITKQLNEANSALNNIASLEHKTNGLQTLSLSNAMILNSRLVNLSRRHTNNIDSFAKRLQALKDQRFASLESAAEVLYQFAPKYEKPTNVWANAIGGASLNSGGNTSLYGTSAGVDAYLNGEVEAIVGGFGSYGYSSFNNQANSLNSGANNANFGVYSRIFANRHEFDFEAQGAVGSDQSSLNFKSALLRDLNQSYNYLAHGAAARASYGYDFAFFRNALVLKPSVGVSYNHLGSTNFESNSTNKTALKNGASSQHLFNASANVEARYYYGDTSYFYMNAGVLQEFANFGSSNALSLNTFKVNVARNPLNTHARVMMGGELKLAKEVFLNLGFIYLHNLISNAGYFASNLGMRYSF

SEQ ID NO: 22645 - protein, 1296 aa, Helicobacter pylori
MELQQTHRKINRPLVSLALVGLLVSITPQKSHAAFFTTVIIPAIVGGIASGAAVGTVSGLLGWGLKQAEEANKTPDKPDKVWRIQAGRGFNEFPNKEYDLYKSLLSSKVDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTNSQSGAKNDKNESAKNDKQESSQNNSNTQVINPPNSGQKTEIQPTQVIDGPFAGAKDTVVNINRINTNADGTIKVGGYTASLTTNAAHLNIGKGGINLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLAPNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGNQAMVNNPDNYKYLIGKAWKNIGISKTANGSKISVRYLGNATPAENGGNTTNLPTNTTNNARFASYALIKNAPFAQTSATPSLVAINKHNFGTIESVFELANRSEDIDTLYANSGAQGRDLLQTLLIDSHDAGYARTMIDATSTNEITKQLNEANSALNNIASLDHKTSGLQTLSLSNAMILNSRLVNLSRRHTNNIDSFAKRLQALKDQKFASLESAAEVLYQFAPKYEKPTNVWANAIGGASLNSGGNTSLYGTSAGVDAYLNGEVEAIVGGFGSYGYSSFSNQANSLNSGANNANFGVYSRIFANQHEFDFEAQGAVGSDQSSLNFKGALLRDLNQSYNYLAYGASARASYGYDFAFFRNALVLKPSVGVNYNHLGSTNFESNSTHKTALKNGASSQHLFNASANVEARYYYGDTSYFYMNAGVLQEFANFGSSNAVSLNTFKVNIARNPLNTHARVMMGGELQLAKEVFLNLGFVYLHNLISNIGHFASNLGMRYSF

SEQ ID NO: 22646 - protein, 1296 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDGADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVAGEVNFNHLTVGDRNAAQAGIIASKKTYIGTLDLWQSAGLNIIAPPEGGYKDKPNNTNSQSGAKNDKNESAKNDKQESSQNNSNTQVINPPNSGQKTEIQPTQVIDGPFAGAKDTVVNINRINTNADGTIRVGGYTASLTTNAAHLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLHFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTSKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNATNNARFASYALIKNAPFAQTNATPNLVAINKHDFGTIESVFELANRSKDIDTLYAHSGAQGRDLLQTLLIDSHDAGYARTMIDATSANEITKQLNTATDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELKLAKEVFLNLGFVYLHNLISNIGHFASNLGMRYSF

SEQ ID NO: 22647 - protein, 1296 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESAKNDKQESSQNNSNTQVINPPNSGQKTEIQPTQVIDGPFAGAKDTVVNINRINTNADGTIKVGGYTASLTTNAAHLNIGKGGVNLSNQASGRTLLVENLTGNITVDGALMVNNQVGGYALAGSNANFEFKAGTDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFVNNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNATNNARFARYALIKNAPFAQTNATPNLVAINKHDFGTIESVFELANRSKDIDTLYAHSGAQGRDLLQTLLIDSHDAGYARTMIDATSANEITKQLNTATDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELKLAKEVFLNLGFVYLHNLISNIGHFASNLGMRYSF

SEQ ID NO: 22648 - protein, 1300 aa, Helicobacter pylori
MELQQERKKMELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLINYTGGDLDVNMQKATLRLGQFNGNSFTSFKDSADRTTRVDFNAKNILIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSSVTNKVNINKLITASTNVAIKNFNINELLVKTNGISVGEYTNFSEDIGSQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNATNNARFASYALIKNAPFAQTNATPNLVAINKHDFGTIESVFELANRSKDIDTLYAHSGAQGRDLLQTLLIDSHDAGYARTMIDATSTNEITKQLNEANSALNNIASLDHKTSGLQTLSLSNAMILNSRLVNLSRRHTNNIDSFAKRLQALKDQKFASLESAAEVLYQFAPKYEKPTNVWANAIGGASLNSGGNTSLYGTSAGVDAYLNGEVEAIVGGFGSYGYSSFSNQANSLNSGANNANFGVYSRIFANQHEFDFEAQGAVGSDQSSLNFKGALLRDLNQSYNLLAYGASARASYGYDFAFFRNALVLKPSVGVNYNHLGSTNFESNSTHKAALKNGASSQHLFNASANVEARYYYGDTSYFYMNAGVLQEFTNFGSSNAVSLNTFKVNTARNPLNTHARVMMGGELKLAKEVFLNLGFIYLHNLISNIGHFASNLGMRYSF

SEQ ID NO: 22649 - protein, 1301 aa, Helicobacter pylori
MELQQTHRKINRPLVSLALVGLLVSITPQKSHAAFFTTVIIPAIVGGIATGAAVGTVSGLLSWGLKQAEEANKTPDKPDKVWRIQAGRGFNNFPNKEYDLYKSLLSSKIDGGWDWGNAARHYWVKDGQWNKLEVDMKDAVGTYNLSGLINFTGGDLDVNMQKATLRLGQFNGNSFTSFKDGANRTTRVDFNAKNISIDNFLEINNRVGSGAGRKASSTVLTLQASEKITSRENAEISLYDGATLNLVSSSNHSVDLYGKVWMGRLQYVGAYLAPSYSTIDTSKVEGEMNFRHLAVGDRNAAQAGIIANKKTNIGVLDLWQSAGLNIIASPEGGYESKNKDNPQNNPKNDTQKTETEPTQVIDGPFAGAKDTVVNIFRLNTNADGTIRVGGFKASLTTNAAHLHIGEGGVNLSNQASGRTLLVENLTGNITVEGALRVNNQVGGSAVAGSSANFEFKAGADTNNGTATFNNDIHLGKAVNLRVDAHTAYFNGNIYLGKSTNLRVNGHSAHFKNIDATKSDNGLNTSALDFSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDTCVVRNTDDIKACGMAIGNQSMVNNPENYKYLEGKAWKNTGINKTANNTTIAVNLGNNSAPTENGGNTTNLPTNATNKARFARYALIKNAPFAQTSTTPNLVAINKHDFGTIESVFELANRSSDIDTLYAHSGAQGRDLLQTLLIDSHNAGYARTMIDATSANEITKQLNTATDALNNIASLEHKTSGLQTLSLSNAMILNSRLVNLSRRHTNNIDSFAKRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGTSTRASYGYDFAFFRNALVLKPSVGVSYNHLGSTNFESNSTHKTALKNGASSQHLFNASANVEARYYYGDTSYFYMNAGVLQEFANFGSSNALSLNTFKVNAARNPLNTHARVMMGGELKLAKEVFLNLGFIYLHNLISNAGYFASNLGMRYSF

SEQ ID NO: 22650 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNILIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAAHLNIGKGGVNLSNQASGRSLLVENLTGNITVDGALRVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGNQSRINTVRLETGTRSIYSGGVKFKGGEKLVINDFYYAPWNYFDARNIKNVEITNKLAFGPQGSPYGTAKLMFNNLTLGPNAVMDYSQFSNVTIQGNFINNQGTINYLVRGGNIETLNVGNAAVMSFNNDIDSATGFYKPLVKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNSTPTENGGNTTNLPTNTTNNARFARYALIKNAPFAQTSATPNLVAINKHDFGTIESVFELANRSKDIHALYAHSGAQGRDLLQTLLIDSHNAGYARTMIDATSANEITKQLNEANSALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELKLAKEVFLNLGFVYLHNLISNIGHFASNLGMRYSF

SEQ ID NO: 22651 - protein, 1296 aa, Helicobacter pylori
MELQQTHRKINRPLVSLALVGLLVSITPQKSHAAFFTTVIIPAIVGGIATGTAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNILIDNFLEINNRVGSGAGRKASSTVLTLQASEGITSDKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTNSQSGAKSDKNESAKNDKQESSQNNSNTQVINPPNSGQKTEIQPTQVIDGPFAGAKDTVVNINRINTNADGTIKVGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTSKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNATNNARFASYALIKNAPFAQTNATPNLVAINKHDFGTIESVFELANRSKDIDTLYAHSGAQGKDLLQTLLIDSHDAGYARTMIDATSANEITKQLNTATDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELKLAKEVFLNLGFVYLHNLISNIGHFASNLGMRYSF

SEQ ID NO: 22652 - protein, 293 aa, Neisseria meningitidis
GVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQNVDDVKIEKYQIHRLVSGYDNDALYASVAVQQQDAKLVEDNSHNSQTEVAATLAYRFGNVTPRVSYAHGFKGSFDDADIGNEYDQVVVGAEYDFSKRTSALVSAGWLQEGKGAYKFVSTAGG

SEQ ID NO: 22653 - protein, 332 aa, Neisseria meningitidis
EVSRVKNQGVKNQGVKNQGVKNQGVKTKTATQIADFGSKIGFKGQEDLGNGMKAIWQLEQKASIAGTNSGWGNRQSFIGLKGGFGTVRAGNLNTVLKDSGDNVNAWESGSNTENILGLGTIGRVESREISVRYDSPVFAGFSGSVQYVPRDNANDKDKYTHMKSSRESYHAGLKYENAGFFGQYAGSFAKYADLNTDAERVAVNTANAHPVKDYQVHRVVAGYDANDLYVSVAGQYEAAKNNEVGSTAIGKKHEQTQVAATAAYRFGNVTPRVSYAHGFKAKVNGVKKASYQYDQVIVGADYDFSKRTSALVSAGWLKEGKGVNKTEKTASM

SEQ ID NO: 22654 - protein, 322 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVRNREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNEVGSTKGKKHEQTQVAATAAYRLGNVTPRVSYAHGFKAKVNGVKDANYQYDQVIVGADYDFSKRTSALVSAGWLKQGKGAGKVEQTASM

SEQ ID NO: 22655 - protein, 1054 aa, Rickettsia honei
ITLQAGGNLITNNINFGAGSTLEFNGPLDGGGNIITYGFKGAIVNGNNATLNVNTKLLIAYDPTAGTIATINIKADNNFAFDASAGDVTILNGQAIVFEDANSILTLSNLTGGGVNNILLAADLAAPGANEGQLIFDGGVNGLNIGSNVAGTVRNIGNAGGNKFENLFINHVVTITDDVNLGIHDLVINDNADFTSSTAFNADAIQIKNATYRIDANGGDLNVPAANIEFAHADAELVLQNSSNANDRTITLGADIDPNNDDEGIVTLNSVNAGRKLTIDGGVTFGRAKRLQAIKFQGAGNLGTVGITFNTANIELDTTGVLELGATTANVTLINDAVQLTQTGNIGGFLDFNAKNGTVTLNNNVNVAGAVQNTGGTNGTLIALGASNLNSVNGIAMLKVGAGAVSITKGGNTSITEIQGNGTALLTLPANFNLTGSINKTGGQALKLNFTNGGSVSGVVGTAANSVGDITTAGATSFASSVNAKGTATLSGTTSFADTFTNTGAVTLAKGSITNFAKNVTATSFAANGATINFGNSLAFNSNITGSGTTLTLGANQVTYTGTGSFTDMLTLNTTFDGAAKSGGNILIKSGSTLDLSGVSTLALVVTATNFDINNIDPNTKYTVISAETAGGLKPTPADNVKVTVNNDNRFVNFTFDASTLTLFAKDVSQEVIDNNFKPGGPLTNIPNAANVKKSLELMEQAQIGSDARLAFGNWGKLTPIQEADAVTHLIQDVVKPSDTITAINNQVILSNISSSLINLNARMDAIQPVAVAAGDEDRDAKFGAWISPFVGNATQKMRNNISGYKSDATGGTIGFDGLVNDDLALGLAYTRADTDIKLKNNKTGDNKVESNIYSVYGLYNVPYENLFVEAIASYSDNKIRSKSRRVIATALATTAYQTANGKYKSESYTGQLMAGYTYAMPENINLTPLAGLRYSTIKDKGYKETGTTYQNLTVKGKNYNTFDGLLGAKVSSNINVGEVVLTPELYAMVDYAFKNKVPAIDARLQGMTAPFPTNSFKQSKTSFNVGVGITAKHKMMEYGINYDTNIGSNISLS

SEQ ID NO: 22656 - protein, 242 aa, Helicobacter pylori J99
MKKFFSQSLLALIASMNALLAMDGNGVFIGAGYLQGQAQMHADINSQKQATNATIKGFDALLGYQFFFGKYFGLRLYGFFDYAHANSIKLKNPNYNSEAAQLAGQILGKQEINRLTSLADPKTFEPNMLTYGGAMDVMVNVINNGIMSLGAFGGIQLAGNSWLMATPSFEGILVEQALVSKKATSFQFLFNVGARLRILKHSSIEAGVKFPMLKKNPYITAKNLDIGFRRVYSWYVNYVFTF

SEQ ID NO: 22657 - protein, 841 aa, Helicobacter pylori J99
MHKKVLLALTASLICQESLFAKDKDYTLGKVSTAGKKDKSDYSGQVNLGYSGITAPKSWQDEEVKKYTGSRTVISNKALTQQANQSIEEALQNVPGLQIRNATGVGAMPTIQIRGFGAGGSGHSDATLMLVNGIPVYMAPYAHIELDIFPVTFQAIDRIDVIKGGGSVQYGPNTYGGIVNIITKPIPNQWENQAAERITYWAKARNAGFAAPPDKTGDPSFIKSLGNNLLYNTYVRSGGMINKHVGIQAQANWVRGQGFRDNSPSSISNYWLDGVYDINENNGIKAYYQYYDFAIAQPGSLSEQDYKINRFANLRPLNQKGGRSQRFGAVYENRFGDLDKVGGTFSFTYYGQLMTRDFQVSSSYNSANTVTCFSEAACRAAGLPAGYNLAVPYYATNYNGWAEVENPVRSINNAFEPKVSLIVNTGKVRQTFIMGLRFMTTTFLQRQYLNTNECPTKTSGEGAGFLCEGANVMSGWKPHIKHGVYRNWNNWRNNYTAVYLSDRIEAWDGRFFIVPGLRYAFVQYNNENAANWMQIPEKDLRKIKHMNNWMPSTNIGFIPVQGDHNVLTYFNYQRSFVPPQLDVLSYGGAEYFTQHFDTVEAGARYTYKDKFSFNADYFRIWARDFATGQYSVYTSGPMKGNVRPVNGYSQGVELELYYRPIRGLQFHAAFNYIDTRVTSHGPLTDLNGDVLKGTSYNKHFPFVSPFQFIFDARYNWRKTTIGISSYFYSRAYSGISNSAAGGYYGMQYYSGGNNYESVLNSGYQCEAWCMTQHEGLLPWYWVWNIQVSQIFWENGRHRVTGSLQINNIFNMKYYFTGIGSSPAGLQPGPGRSVTAYLNYTF

SEQ ID NO: 22658 - protein, 211 aa, Helicobacter pylori J99
MKFFSKDLFKKVTPLFLSVYFLNPTLTQAKSRFYVASQYQVGKMIMKKYNDLKRTIEGASFSLGWEINPTNYWFYSRYYFFMDYGNVILNKRTGAQANMFTYGFGGDLIVEYNKNPLYVFSLFYGMQVAENTWTISKHSANFIIDDWRSIQGFSLKTSNFRMLGLVGFKFQTVLFHHDASIEVGIKWPFAFEYDSPFVRLFSVFISHTFYL

SEQ ID NO: 22659 - protein, 877 aa, Helicobacter pylori J99
MLRNQFRIVFVSCIVASNLQAQETTHTLGKVTTKGERTFEYNNKMYIDRKELQQRQSNQIRDIFRTRADVNVASGGLMAQKIYVRGIESRLLRVTIDGVAQNGNIFHHDANTVIDPNMIKEVEVIKGAANASAGPGAVAGKLSFTTIDANDFLRKNQTYGAKAEAAFYTNFGYRMNATAAYRGKNWDILAYYNHQNIFYYRDGNNAFRNVFHPNYDLQDPSNSDMSVGTPSEVNSVLAKINGYINETDSISVSYNLTRDNSTRLLRPNTTSALSKANDPGSQPAPFVIDFGKELAHTINFNHNLSLKYKHEGGPNFNQPRVESTAFLGVRGGNYNPVVNPFAYNSNEPANPDYIPEVKEWCNNPDNISQCTQGAIRPSNGGYQIGYGTPNSINWQGTSDSSGGAQAGYGQLNAISTSANVYHGLVPKNPDYDMTPPNAQNPSANDWTLGNADAEGTLARRIFLINSGVNFKVTHPISEDYGNVFEYGMIYQNLSVFSGLDKGKNGYYKNNIDPNDPNGPGLPYRHYYTDQSSQYPQNLNTPNPLYRNMPQNSHAIGNIIGGFMQANYNILSNVIVGAGTRYDIYTLLDKNGRTHVTSGFSPSATVLYNPIESIGLKVSYAYVTKGALPGDGVLMRDPTVIYQRNLRPAIGQNVEFNVDFNSKYFNVRGAAFYQVINNFINSYGQDTSKNGGGNATAKNMSGNLPETINIYGYEVSGNVRYKNFLGTFSVARSWPTARGHLLADTYALAATTGNVFILKADYDVRRWGLTLTWLSRFVTNMYYEGYSIYYPQYGLIKIHKPGYGVHNVFINWTPPSKKWQGLRISAVFNNILNKQYVDQTSVFQASADAPASDMIPKGKRMALPAPGFNARFEVSYQF

SEQ ID NO: 22660 - protein, 481 aa, Helicobacter pylori J99
MMVMGRQTGRRAAVTAIVIMNAVLAGGSIAHAQTSGALRKPDAQGNFNPRVVEGLTKPRLTPEEKKEEILAPFSRKLRESGLKLHGTFLDFMEANPSAGTYTGNTANSGYLIVGADADLEKILGIKGGTFHFEETIFTLRSNVLISGEIGDNSIGYPPPYNLRPNQLSLLTYEQHLLNDKLVIEAGRTHPNRYFAAPNCQVINSCYQDVLYINAGYISPQYSMWGGRVSYAFSPGWYVQAGSFATNPNANSRSGWDWGLETPQGALTMVEIGEKTDFSNSAYPGSYSLTAFYNNADHNSFKTVSGQPKAYFPGDPLRQSHGTQGLVLNTQQTVWRADGGKGKTLTPTALVLYSGLGLGLDATAPIQSDLYVGATLQAPFQSRPNDRFGVKIKWERMTGALANYLAQANAVAGGSGGDFSRDKAIFELNAHIQLYSAVAFEPVFDYIVNPNSYYTPTAAKRPQDGVYVGGTFILPFGAMLGL

SEQ ID NO: 22661 - protein, 714 aa, Helicobacter pylori J99
MLKRISTSSIILSCLLVLANYTAAEDLFDFSLQELQSIPVEVASLFEDDALDVASSVAVIDRSDWQTRDYHTLSNGLESVPSVFSNSTWGGTEIHAIRGFASELSVRGIAYSLEDVPLGTYVYASTGYMFPRAPLGILDQVEMIRGPGSTLYGTDAFHGVINYQLREPDLNNTQVTLKAGSHDWWGKGTDVTHSQYSGQWQIHTGFTHHNESSHGQDFRYTDPFTGDQEIGTREQAWSSNAGFLKIKHGQVSSNAGQWQAMVFANQYRGEGFTGIGQQLFKGFDGIIDLESFSLAQSGDQTNNESELMLARLGHEILLDNDIQLKQRIYTWHSKQEWQFDNTQYPESVDTISSTTLNCRENTADTASDTIASLYCSHYLYQGADESRSGYEIQAKQRTNAWNTQWVVGAGFDRIHVDESEIRREAPDGEIRLRYVNPFQDKSREISYAFAQGRSGFFNDQLLVTYGVRWDQYSDVSDHASPRLGVVHRLASNWSHKLLYGHAYRAPTAIEFLGSGPFLGNENLKAEVIDTHEYVLQYIGSQLQWETTVFYSEWDDAIAVVQTGSETEQQYVNLNSNYSKGVEFSLKGLQGPWHFQGNASYVETDTSSTDVNFKAFPEWMMSANLEYRGQGWQAGIWQRQQWQYELTDNVDEQSGKEDYSRTDFYAQYKVQKNSSLGLAIYNVADVHNTLPSYYASENGLPQHGREWSVHYTMDF

SEQ ID NO: 22662 - protein, 231 aa, Helicobacter pylori J99
MFKKIIFFGVFLMGGFVIPPLDAMPILHNKTPKKNYQEAHEKLYRSIINRQKLTRKKSGWYFLGGFGAVEATKDYQGQEMKDWIATLNLKTGVQSFFKKYIGIRGVFAWDLGSGKVNYQSHKDPTNSFFTMLAVGLDVIMEFPLGSYKHYLGAFGGARGALVVYTDKQNFKFFKHSVVSGGLAINGGVMLTLFLRHRIELGFKILPTARLLSSSKRFETSPLFYAAYSYKF

SEQ ID NO: 22663 - protein, 746 aa, Helicobacter pylori J99
MLKLASKTICLSLIGSFTAVEAFQKHQKDGFFIEAGFETGLLQGTQTQEQTIATTQEKPKPKPKPKPITPQSTYGKYYISQSTILKNATELFAEDNITNLTFYSQTPVYVTAYNQESAEEAGYGDSSLIMIQNFLPYNLNNIELSYTDNQGNVVSLGVIETIPKQSQIILPASLFNDPQLNADGFQQLQTATTRFSDSSTQNLFDKLSKVTTNLQMTYINYNQFSSGNGTGSKPPCPPYENQANCVAKVPPFTSQDAKNLTNLMLNMMAVFDSKSWEDAVKNAPFQFSDNNLSKPCYSDYLTCVNPYNNGLVDPKLIAKNAGDEYNIENGQTGSVILTPQDVIYSYRVTNNLYVNLLPTRGGDLGLGSQYGGPNGPGDDGTNFGALGILSPFLDPEILFGKELNKVAIMQLRDIIHEYGHTLGYTHNGNMTYQRVRMCEENNGPEERCKGGKIEQVNGQEVQVFDNGHEVRDTDGSFYDVCSRFGGQNQPAFPSSYPNSIYTDCSQVPAGLIGVTSAVWQQLIDQNALPVDYTNLSSQTNYLNASLNTQDFATTMLSTISQSLSSTKSSATTYRTSKTSRPFGAPLLGVNLKMGYQKYFNDYLGLSSYGIIKYNYAQANNKKIQQLSYGVGMDVLFDFITNYTNEKNPKNNLTKKVFTSSLGVFGGLRGLYNSYYLLNQYKGSGNLNVTGGLNYRYKHSKYSVGISVPLVQLKSRVVSSDGATTNSITLNEGGSHFKVFFNYGWIF

SEQ ID NO: 22664 - protein, 666 aa, Helicobacter pylori J99
MKKTLLLSLSLASSLLSAEDNGFFISAGYQIGEAAQMVKNTGELKKLSDTYENLSNLLNNFNNLNRAVTNASSPSQINDAIDNLKANTQGLTGEKTNSPAYQAVSLALNAAVGLWNVIAYNVQCGPGKSNQQSVIFEGQPGHNSSSINCNLTGYENGVSGPLSIENFKQLNRAYQTIQQALKQDSGFPVLDSTGKQVTIKITTQTNGQTSEETTTITNNAQTLLQEASKMISVLTTNCPWVNTDHNSNGGAPWHLNTTGNVCEVFATEFSAVTSMIKNAQEIVTQAQSLNAQNNQNAPQDFNPYTSSSKAFAQNMLNHAQAQAKMLELADQIKTNLNTIPKHFVTDYLAACRNGGGTLPNEGVTSNTWGAGCAYVEETITALSNSLAHFGTQAEQIKQSELLARTILDFRGSLSNLNNTYNSITTTASNTPNSPFLKNLISQSTNPNNPGGLQAVYQVNQSAYSQLLSATQELGRNPFRRVGLISSQTNNGAMNGIGVQIGYKQFFGEKRRWGLRYYGFFDYNHAYIKSSFFNSASDVFTYGVGTDVLYNFINDKATKNNKISFGVFGGIALAGTSWLNSQYVNLATFNNFYSAKMNVANFQFLFNLGLRMNLAKNKKKASDHAAQHGVELGVKIPTINTNYYSLLGAQLQYRRLYSVYLNYVFAY

SEQ ID NO: 22665 - protein, 641 aa, Helicobacter pylori J99
MKKTKKTILLSLTLAASLLHAEDNGVFLSVGYQIGEAVQKVKNADKVQKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYQQDNQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRNMGMIASSTTNNGALNGLGVQVGYKQFFGEKKRWGLRYYGFFDYNHAYIKSNFFNSASDVWTYGVGSDLLFNFINDKNTNFLGKNNKISFGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 22666 - protein, 1229 aa, Helicobacter pylori J99
MIKKAKKFIPFFLIGSLLAEDNGWYMSVGYQIGGTQQFINNKQLLENESSINSITQSAIDIAGPTTGLITLSSQSVIDALGYGVSNTVGNQLEGISNILNQIGKRKDFFSSRQISSISQQIIGLKGSSDPLKAHSSQITAKLLFNTQSSFNQGISLSSSIISSINSLNPSNNTKEVKAQLQNTTQSMAELLQQIEHSITKTTSTTYAQSLLSNLTDAVNASSNNTTYVSALKNALTTLGVGYFPTTTTTHVVLNPPGQIVFYPTNSILGSTSSNSNNQQQYNNTLLMNTLQGQLSANNQNNPNGCANQVQCLEQFIQNLAPLAATPTSNNQANQQVQAIAQKLQSVAINTLDNNAINNTTYNLNNLHNALNFQAYESTIEQYNNALKQISWISFTEPKNLLKNTSNNYQIGTVTNAQGQNISAYDCASATGSLSGDTSSGISCSATSSTNNTNSFDNSLVATSKVQTIGGKEQIGVNSFNLVSQVWSVYNSLKTSEENLQKNAQILCPNSSNQDACNNNNSGGLSISGNSQLQNILSSRTSANTQAKSNASKLKATVVVNNNEEAKTTNFNQSSGATTQSPNSTVMGALNTVLQNVSNFQQSIQSAFQSQESNIQAWANAIYNTNGSQSQEMTPNNNQNLRIQLRANFYQLINTINQQVPTDMSALINQSQQTQQTSGSASNNNACASGMSGSSGNWCNQQWSDSKAYYSGLQSALGYQTQATTQSGSSGGNSITYNVQQITLTSNGLLNNIISSLKGFSSSGNNGGNGGSSGNGTSQINTAYQMLTDASDGKLGTYSSSNSGSNNGYTPCNSTNGSNGTSGSNCYEPNKQQSATTATTSETNLQKVYNDAQKIANIIASSGNNKGVENGLKQFFEALKNNSSSLSNLCNGSSGSSSGACTGGLINLLGAIPTNGVSDTNNLINLLTEFIKTAGFIQNNNNNSSDTSLKNAFQAITSAISQGFQALQNDISPNAILTLLQEITSNTTTIQSFSQTLRQLLGDKTFFMVQQKLIDAMINARNQVQNAQNQANNYGSQPILSQYVAAKSTQHGMSNGLGVGLGYKYFFGKARKLGLRHYFFFDYGFSEIGLANQSVKANIFAYGVGTDFLWNLFRRTYNTKALNFGLFAGVQLGGATWLSSLRQQIIDNWGNANDIHSTNFQVALNFGVRTNFAEFKRFAKKFHNQGVISQKSVEFGIKVPLINQAYLKSAGADVSYRRLYTFYINYIMGF

SEQ ID NO: 22667 - protein, 696 aa, Helicobacter pylori J99
MQNFVFNKKWLIYSSLLPLFFLNPLAAEDDGFFMGVSYQTSLAVQRVDNSGLNASQDASTYIRQNAIALESAAVPLAYYLEAMGQQTRVLMQMLCPDPSKRCLLYAGGYQQNAQNGDTGNNPPRGNVNATFDMQSLVNNLNKLTQLIGETLIRNPENLPNAKLIEVKFGNQSTVIALPEGLANTMNALNNDITNALTTLWYNQTLTNKSFNSGNSVNFSPQVLQHLLQDGLATASNNQTICSTQNQCTATNEAKSIAQNAQNIFQALMQAGILGGLANEKQFGFTYNKAPNGSDSQQGYQSFSGPGYYTKNGNTTQAPLKALPAGATIGSGNGQYTYHPSSAVYYLADSIIANGITASMIFSGMQNFANKAAKLTGTSSYSQMQDAINYGESLLNNTVAYGDFITNWVAPYLDLNNKGLNFLPSYGGQLNGANHQTPQNNLTPQQAQQEQKVIMNQLEQATNAPTPAQIDRILANPYSPTAKTLMAYGLYRSKAVIGGVIDEMQTKVNQVYQMGFARNFLEHNSNSNNMNGFGVKMGYKQFFGKKRMFGLRYYGFYDFGYAQFGTGSSLVKATLSSYGAGTDFLYNVFTRKRGTEAIDIGFFAGIQLAGQTWKTNFLDQVDGNHLKPKDTSFQFLFDLGIRTNFSKIAHQKRSRFSQGIEFGLKIPVLYHTYYQSEGVTAKYRRAFSFYVGYNIGF

SEQ ID NO: 22668 - protein, 383 aa, Helicobacter pylori J99
MKRALLATSAFALAVSAHAQSSVTLYGRLDSGVEYMTGVPTGPSATGAATGSTHRFRAESGDWGTSLWGLKGAEDLGGGYKAVFQLEGYFNAMTGAGPGGGGLFNRWATVGFVSPNYGTFLMGRELFIGNNLWDFDPFGQTAWSSASLVRGRNWPLVSNALSYQSPKIGGFDFYGQYALSNATNWNGNGTTPQGRQAGAQITYTSALFQVRGMYDEIRNPANGLLYGPSVSTVNGSNSAGGVFAASREYSAFVNVFLGQFKVQGAYQAIRSSSATAVLPGQPTTLDQEWGGVTWQATSAAALIGAVYHVNGNNGSGNATIYTIGGSYNLSKRTLLDIQLATVRNSKTANFGLNANNPGTAVATDNPLPGHSQSGVYAGIQHAF

SEQ ID NO: 22669 - protein, 815 aa, Helicobacter pylori J99
MNKTSLNLAVLAALPLFYSTVSVAETSSLDAIETIQVTGSRINRTDMETASPVTVISAELIAQSGYASVEEILSKQPVAAGMNLGATSNNGSGGSATVNLRGMGTNRTLVLLNGRRMVASGTGADSSVDLNTIPVAMIKSIEILKDGASAVYGSDAIAGVVNIITKQDFEGTKIAADVSETAQGDGTSGGVSILHGVEFAGGNLVIGAQFSERGKIIQADRDHVEPGCSSFIPEGTLGGKTPDGQGGFKKRQHCYDFTQDSYAQTPNELFSAFSSFTTELDADTRINADLMYTRRESNQQMAPQPANIDLLSAKLADKYSQLFADTDGNVAQELNYRRRMTDAGPRISEQVTDTYRFSLGITGELESDASWDVSVTYGRNDSEDKVQNSIHAGNMEKSIYANQDLWFSGDALSRDFLASQGTMYTETNKGGNEQFIMAAGLSGVTSFDLGYAVGIENRFESGFYTPDLITQAGESTAAQQDPTSGNYSVQSVYGEVSMPVNDQLSLEAATRFDNYSTFGTAVTWKVGATYRFNDEFMMRSVAATGFRAPNVAELYGGNSGSFDYLDDPWGNAPDAQILVNYTGDLNLQPEESESFTFGMVWEITDGLSSTLDYWSFDITDAISRLNVQNQMNNCFAGQQQACDSINITPAGDLSDMTSVLTNVGSQQTSGIDWNIGYRQDSYRITLDTTYLIEFKEDGINYEGTIDGNMGGYSKLKANFTVDYNLTDAVTLAYNAQYIQGMDGNNDGDKYTTDDVVYHNVSAAYEVNDQWRINGGVKNLLDTDPEYVPDGNDMNTIPSLYDVVGRTFYLSTSYRF

SEQ ID NO: 22670 - protein, 279 aa, Helicobacter pylori J99
MLRLTTALLLVTSPLAAQEFYSSAQLSFGQSQTAGAPVAIQSATGTLLTGRTDLSFGRLAHSGLYIQADLGLAATNNANVAPNTANTSNSLMLRMGRSADRFSYGVFVGALQSDHDNDVSDDAMRLLAGIEGSYMLNDRWSFNGHLGYMTGTSGTDSVATATNGIATGVGITFAATDRLSFGTSIGYLNAKMDAPSTVVELWTLEARVDYDIQVMPGLSLFAAAQYGESHQKEIVGPDDITDTTSIMAGITYRFGGKRPRTADLTYMEPFLANTGGILE

SEQ ID NO: 22671 - protein, 661 aa, Helicobacter pylori J99
MRKLFIPLLLFSALEANEKNGFFIEAGFETGLLEGTQTQEKRHTTTKNTYATYNYLPTDTILKRAANLFTNAEAISKLKFSSLSPVRVLYINGQLTIENFLPYNLNNVKLSFTDAQGNTIDLGVIETIPKHSKIVLPGEAFDSLKEAFDKIGPYTFFLPKFEATSTSISDANTQRVFETLNKIKTNLIMKYSNENPNNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALDPKKLFGDDLKTINLDDLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLSTIQKTFVTSSVTNHYSSSASQSFRSPILGVNAKIGYQNYFNDFIGLAYYGIIKYNYAKASSEKVQQLSYGGGIDLLVDFITTYSNKNSPIGIQTRRNFSSSFGIFGGLRGLYNSYYVFNKVKGSGNLDVATGLNYRYKHSKYSVGISIPLIQRKASVVSNGGDYTNSFVFNEGASHFKVFFNYGWIF

SEQ ID NO: 22672 - protein, 369 aa, Helicobacter pylori J99
MQFQKALLHSSFFLPLFLSFCIAEENGAYASVGFEYSISHAVEHNNPFLNQERIQIISNAQNKIYKLHQVKNEITSMPKTFAYINNALKNNSKLTPTEMQAEQYYLQSTFQNIEKIVMLSGGVSSNPQLVQALEKMQEPITNPLEFEENLRNLEVQFAQSQNRMLSSLSSQIAAISNSLNALDPNSYSKNISSMYGVSLSVGYKHFFTKKKNQGLRYYLFYDYGYTNFGFVGNGFDGLGKMNNHLYGLGIDYLYNFIDNAKKHSSVGFYLGFALAGSSWVGSGLSMWVSQTDFINNYLTGYQAKMHTSFFQIPLNFGVRVNVNRHNGFEMGLKIPLAMNSFYETHGKGLNTSLFFKRLVMFNVSYVYSF

SEQ ID NO: 22673 - protein, 2529 aa, Helicobacter pylori J99
MAFKKARLISKFISKGSFKLNKISKKIFTLNQILKCEKPLKRHKKALKPIKKLSNRNKSFLKASVLLIGALGGLSHLRANECRYWSWSSWSYQDNIESGPNSPTHNSYCLFSSTQGSGTYYLNTLTTYSAGGASFTQKFNNGTLNVGENIRFGGTGINGGDVGYITGTYDAQTINFNSSHLTTGNSYADGGGATLNFNAANNITINQASFDNSHAGTQKSYMNFKGSNIKVSGSSFTDDTDGGFSFSGNSNNSTISFNQTSFNQGTYHFSNSATLSFNHSAFNQGTYNFNSTQSAFNNSAFNQGTYHFNGNASFDNDTFNQGTYSFNTSKVSFSGINTLNSSSPFASLKGSVSFGSDAIFNLNQTLNNQTYDILTTNGAIQYGVYQSYLWDLINYKGDKAISHVEVGNNTYDVTFDINGQDETLQETFNKQSIITQFLGDDLQQQAQKTYQQDLSNSQSALNNAASDNKIANSDTDYTKNKNATIKKDAQGLENTNQQIAQDEQALQGDLDKLKQLANSPTGFSEQAFNQAQKQEQQDEQTLQNEEKTFNSEQEGLKQAIQQAQAQQQKQQQKQEQQQAQQTYQEDLTHSQSALNDVASDNTIASNDTNYTNNQNTAIKEDAQGLENTNQQIAQDEQALQGDLDKLKQLANSPTGFSEQAFNQAQKQEQQDEQTLQNEEKTFNSEQERLKQAIANAKPTSPTPSHAPTPTKHTAPNTPPNKVPPTPPTQNPPAESVWSGVYWLQNKTYSNKGIYYIDPNLSGQSGQSGNTLSTYTANLFGRSFSVNIQNGTLIIGNNTESVNSNGLIWIGHGGFGYITGTFSAANIYLTNNFKTGEGVSNSDGGGANITFKASDNITMDGLNYNDAETVTKMIQTGASQHSYATFDALNNISVTNSSFSDMTWGKFSFSAKNISFSNASFSGFTNPGGSSVISANATNSLSFINSRLNGGAVYNLQANSLIFNNTQAVFNVLYSRGTSNFNATTQLLGNTNFTLSSQSLLNFNGDTTLQNNANITLGNKSQAAFKNSLTLDNNSNLSLDNQSVLNANNTSAFNNQASLNIYNGSQATFNSLFFNGGTLSLNASSKLNASNASFSNNTTINLDDSVLSASNTSSLNANINFQGASQADFGGNTIIDTASFNFDSASSLNFNNLTANGALNFNGYTPSLTKALMSVSGQFVLGNNGDINLSDINIFDNITKSVTYNILNAQKGITGISGANGYEKILFYGMKIQNATYSDNNNIQTWSFINPLNSSQIIQESIKNGDLTIEVLNNPNSASNTIFNIAPELYNYQASKQNPTGYSYDYSDNQAGTYYLTSNIKGLFTPKGSQTPQAPGTYSPFNQPLSSLNIYNKGFSSENLKTLLGILSQNSATLKEMIESNQLDNITNINEVLQLLDKIKITQVQKQALLETINHLTDNINQTFNNGNLIIGATQDNVTNSTSSIWFGGNGYSSPCTLDSATCSSFRNTYLGQLLGSTSPYLGYINADFKAKSIYITGTIGSGNAFESGGSADVTFQSANNLVLNKANIEAQATDNIFNLLGQKGIEKIFNQGNLANVLSQVAMEKIKQAGGLGNFIENALSPLSKELPASLQNETLGQLIGQNNLDDLLNNSGVMNAIQNIISKKLSIFGNFVTPSIIENYLAKQSLKSMLDDKGLLNFIGGYMNASELSSILSVVLKDITNPPTSLQKDIGVVANDLLNEFLGQDVIKKLESQGLVSNIINNIISQGGLSGVYNQGLGSVLPPSLQNALKENDLGTLLSPRGLHDFWQKGYFNFLSNGYVFVNNSSFSNATGGSLNFVANKSIIFNGDNTIDFSKYQGALIFASNDVSNINITTLNATNGLSLNAGLNNVSVQKGEICVNLANCPTTKNSSSTNSSVTPTNESLSVRANNFTFLGAIASNGAIDLSQVKNNSVIDTLNLNENAALQANNLTITNAFNNASNSTANINGNFTLNQQATLSTNASGLNVMGNFNSYGDLVFNLSHSVSHAIINAQGSATIMANNNNPLIQFNTSSKEVGTYTLIDSAKAIYYGYNNQITGGSSLDNYLKLYTLIDINGKHMVMTDNGLTYNGQAVSVKDGGLVVGFKDSQNQYIYTSILYNKVKIAVSNDPINNLQAPTLKQYIAQIQGTQGVDSIDQAGGSQAINWLNKIFETKGSPLFAPYYLESHSTKDLTTIAGDIANTLEVIANPNFKNDATNILQINTYTQQMSRLAKLSDTSTFASADFHERLEALKNKRFADAIPNAMDVILKYSQRNRVKNNVWATGVGGASFINGGTGTLYGINVGYDRFIKGVIVGGYAAYGYSGFHANITQSGSSNVNMGVYSRAFIKRSELTMSLNETWGYNKTFINSYDPLLSIINQSYKYDTWTTDAKINYGYDFMFKDKSVIFKPQIGLAYYYIGLSGLRGIMDDPIYNQFRANADPNKKSVLTINFALESRHYFNKNSYYFVIADVGRDLFINSMGDKMVRFIGNNTLSYRDGGRYNTFASIITGGEIRLFKTFYVNAGIGARFGLDYKDINITGNIGMRYAF

SEQ ID NO: 22674 - protein, 249 aa, Helicobacter pylori J99
MNDKRFRKYCSFSIFLSLLGTFELEAKEEEEKEERKTERKKEKNAQHTLGKVTTQAAKIFNYNNQTTISSKELERRQANQISDMFRRNPNINVGGGAVIAQKIYVRGIEDRLARVTVDGAAQMGASYGHQGNTIIDPGMLKSVVVTKGAAQASAGPMALIGAIKMETKSASDFIPKGKDYAISGAATFLTNFGDRETVMGAYRHNHFDALLYYTHQNIFYYRDGDNATKDLFRPKAENKVTEVLASKTM

SEQ ID NO: 22675 - protein, 528 aa, Helicobacter pylori J99
MKQNLKPFKMIKENLMTQSQKVRFLAPLSLALSLSFNPVGAEEDGGFMTFGYELGQVVQQVKNPGKIKAEELAGLLNSNTTNNTNTNIAGTGGNVAGTLGNLFMNQLGNLIDLYPTLNTTNIQQCGATNSGGSATTAAATTSNSPCFQGNLALYNEMVGSIKTLSQNISKNIFQGDNNTTSQNLSNQLSELNTASVYLTYMNSFLNANNQAGGIFQNNTTQAYRDGVTAQQIAYILKQASITMGPSGDSGAAAAFLDAALAQHVFNSANAGNDLSAKEFTSLVQNIVNNSQNALTLANNANISNSTGYRVSYGGNIDQARSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLANRPTATKFQFLFDVGLRMNFGILKKDLKSHNQHSIEIGVQIPTIYNTYYKAGGAEVKYFRPYSVYGVYGYAF

SEQ ID NO: 22676 - protein, 515 aa, Helicobacter pylori J99
MIKKNRTLFLSLALCASISYAEDDGGFFTVGYQLGQVMQDVQNPGGAKSDELARELNADVTNNILNNNTGGNVAGALSNAFSQYLYSLLGAYPTKLNGNDVSANALLSGAVGSGTCAAAGTAGGSTLNTQSACTAAGYYWLPSLTDRILSTIGSQTNYGTNTNFPNMQQQLTYLNAGNVFFNAMNKALEAKNGSSGASGATGSDGQTYSTQAIQYLQRQQNILNNAANLLKQDELLLEAFNSAVAANIGNKEFNSAAFTGLVQGIIDQSQLVYNELTKNTISGSAVNGAEINSNQANAVQGRASQLPNALYNAQVTLDKINALNNQVRSMPYLPQFRAGNSRSTNILNGFYTKIGYKQFFGKKRNIGLRYYGFFSYNGASVGFRSTQNNVGLYTYGVGTDVLYNIFSRSYQNRSVDMGFFSGIQLAGETFQSTLRDDPNVKLHGKINNTHFQFLFDFGMRMNFGKLDGKSNRHNQHTVEFGVVVPTIYNTYYKSAGTTVKYFRPYSVYWSYGYSF

SEQ ID NO: 22677 - protein, 737 aa, Helicobacter pylori J99
MKKHILSLTLGSLLVSTLSAEDDGFYTSVGYQIGEAAQMVTNTKGIQDLSDRYESLNNLLNRYSTLNTLIKLSADPSAINAARENLGASAKNLIGDKANSPAYQAVLLAINAAVGFWNVVGYVTQCGGNAHGRESTSSTTIFNNEPGYRSTSITCSLNGHRPGYYGPMSIENFKKLNEAYQILQTALKQGLPALKENNRTVNVTYTYTCSGDGNDNCSPNVTGVNDQHNGTKTTTQTIDGKSVTTTISSKVVDSNAKDNTSHVSYTEITNHLNDVPDSAQALLAQASTLINTINTACPFFHANNSSEANAPKFSTTIGKICGAFSEEISTIQKMITDAQELVNQTSVINSNEQSTPVDGNNGKPFNPFTDASFAQGMLANASAQAKMLNLAHQVGQAINPENLTGSFKNFVTGFLATCNNLSTAGTGSTQGSAPGTVTTQTFASGCAYVEQTITNLTNSIAHFGTQEQQIQQAENIADTLVNFRSRYSELGNTYNSITTALSKVPNAQSLQNVVSKKNNPYSPQGIDTNYYLNQNSYNQIQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGVKIPTINTNYYSFMGAELKYRRLYSVY

SEQ ID NO: 22678 - protein, 707 aa, Helicobacter pylori J99
MFLRSYPKLRYALCLPLLTETCYSEERTLNKVTTQAKRIFTYNNEFKVTSKELDQRQSNEVKDLFRTNPDVNVGGGSVMGQKIYVRGIEDRLLRVTVDGAAQNGNIYHHQGNTVIDPGMLKSVEVTKGAANASAGPGAIAGVIKMETKGAADFIPRGKNYAASGAVSFYTNFGDRETFRSAYQNAHFDIIAYYTHQNIFYYRSGATAMKNLFHPTQADKEPGTPSEQNNALIKMNGYLSDRDTLTFSWNMTRDNATRPLRSNAIGLAYPCEAPFSPDGAQGCPNVLDSFTRYMYRSINSANNLSLQYKREAGNSFGDPRLDFTLYTSIRNAQFDPLFDPNGVYAKFPTSLASEWEKENYPCVEGAYCTPSFSDVDKPSSQPRNLFLNNTGLNLKVAHVIDEATDSLFEYGFNYQNLSVFDARIPKSELYRPNQVYTDDKGQKQIACTLVDNNPNDPTLCQRGKANGNIYGGYVQANYSPHKIITFGAGVRWDAYTLYDKDWNHRYTQGFSPSAALVLSPIEPLSLKITYSQVTRGVMPGDGVYMRQNDLRYAKNIKPEVGSNAEFNIDYSSQYFSGRAAAFYQALDNFISQYAQNLIVTNLNQAIRIYGYEVGGTFRYKGVSLNVGISRTWPTTRGYLMADSYELAASTGNVFIIKLDYTIPKTGINLAWLSRFVTGLDYCGFDIYLPDYGTAEKPKTPTDLAKCGF

SEQ ID NO: 22679 - protein, 587 aa, Helicobacter pylori J99
MKNFSPLCYFKKLKKRHLIALSLPLLSYANGFKIQEQSLNGTALGSAYVAGARGADASFYNPANMGFTNDWGENRSEFEMTTTVINIPAFSFKVPTTNQGLYSVTSLEINKSQQNILGIINTIGLGNILKALGNTAATNGLQQAFNRVQGLMNLTNQKVVTLASPPDTQIVNGWTGTTNFVLPKFFYKTRTHNGFTFGGSFSAPSGLGMKWNGKGGEFLHDVFIMMVELAPSMSYTINKRFSVGVGLRGLYATGSFNNTVYVPLEGASVLSADQILNLPNNVFADQVPSNMMALLGNIGYQPALNCQKAGGDMSDQSCQEFYNGLKKIMGYSGLVKASANLYGTTQVVQKSNGQGISGGYRVGSSLRIFDHGMFSVVYNSSVTFNMKGDLVAITELGPSLGSVLTKGSLNINVSLPQTLSLAYAHQFFKDHLRIEGVFERTFWSQGNKFLVTPDFANATYKGLNGTVASLDSETLKKMVGLANFKSVMNMGAGWRDTNTFRLGVTYMGKSLRLMGAIDYDQAPSPQDAIGIPDSNGYTVAFGTKYNFRGFDLGVAGSFTFKSNRSSLYQSPTIGQLRIFSASLGYRW

SEQ ID NO: 22680 - protein, 792 aa, Helicobacter pylori J99
MNGYLRVKTPYFLASVVLIFWTFNSFMSAKDKHHFLKKVTTTEQKFNSSAPLSWQSEEVRNSTSSRTVISNKELKKTGNLNIENALQNVPGIQIRDATGTGVLPKISVRGFGGGGNGHSNTGMILVNGIPIYGAPYSNIELAIFPVTFQSVDRIDVIKGGTSVQYGPNTFGGVVNVITKEIPKEWENQAAERITFWGRSSNGNFVDPEEKGKPLAQTLGNQMLFNTYGRTAGMLGKHIGISAQGNWINGQGFRQNSPTKVQNYLLDAVYKINATNTFKAYYQYYQYNSYHPGTLSAQDYAYNRFINERPNNQDGGRAKRFGIVYQNYFGDPDRKVGGDFKFTYFTHDMSRDFGFSNQYQSVYMSSQNKILPFKGKGKISATNPNCGLYSYSDTNSPCWQFFDNIRRFVVNAFEPKLNLIVNTGKVRQTFNMGMRFLTEDLYRRSTTRKNPSMPNNGSGFDAGTSLNNFNNYTAVYVSDEINFNNGMLTITPGLRYTFLNYEKKDAPPFKEGQTGKTIKDRYNQWNPAVNVGYKPIKELLFYFNYQRSYIPPQFSNIGSFVGTSTDYFQIFNVMEGGSRYYFNNQVSFNANYFVIFANNYFTGRYGDNKEPVNARSQGVELELYYTPIRGLNFHAAYTFIDANITSHTMITNPANPKGPKKDIFGKKLPFVSPHQFILDASYTYAKTTIGLSSFFYSRAYSDVLNTVPFTEYAPMIKNGAITTRTAGMTPWYWVWNLQISSALWERKNQSVSASLQINNIFNMKYWFSGIGTSPNGKEAAPPRSITAYVSYNF

SEQ ID NO: 22681 - protein, 278 aa, Helicobacter pylori J99
MNKLLKGGVLAFFLSVYLRADDLVTYTIIKKEDLGYQRFLAKKCLRGKAHPPCFAASKKPKRKLFNIDKSSHYYGTSVVQMSWLQSREKFENHSKYRDIPFAEVSLIYGYKQFFPKKERYGFRFYVSLDYAYGFFLKNKGTLGDSLRESSQIPKSYREKLQRKETFINAIFYGAGADFLYKRAFGTLILGMNFVGETWFYETKIFKKWAKDLSSVYHPYMFQVMLNVGYRYRFSRYKNWAIELGARIPFLTNDYFKTPLYTLHFKRNISVYLTSTYDF

SEQ ID NO: 22682 - protein, 305 aa, Helicobacter pylori J99
MGRIESKKRLKAFIFLASLGVLWGNAAEKTPFFKTKNHIYLGFRLGTGANVSTSMWQQAYKDNPTCPSSVCYGEKLEAHYKGGKNLSYTGQIGDEIAIDKYHILGLRVWGDIEYAKAQLGQKVGGNTLLSQANYNPSAIKTYDTASNAQGSLNLQKTPSPQNFLFDNGHFMAFGLNVNVFINLPIDTLLKLALKTEKMLFFKIGVFGGGGVEYAILWSSQYKNQNTKQDDKFFAAGGGFFVNFGGSLYIGKRNRFNVGLKIPYYSLSVQSWKNFGSSNVWQQQTIRQNFSVFRNKEVFVSYAFLF

SEQ ID NO: 22683 - protein, 638 aa, Helicobacter pylori J99
MKKTILLSLSLSLASSLLHAEDNGFFVSAGYQIGEAVQMVKNTGELKNLNEKYEQLSQSLAQLASLKRSIQTANNIQAVNNALSDLKSFASNNHTNKETSPIYNTAQAVITSVLAFWSLYAGNALSFHVTGLNDGSNSPLGRIHKDGNCTGLQNCFMKKETYDKMKTLAENLQKAQGNLCALSECSSNQSDKTSMTKALETAQQLMNLIEQTKVSMVWKNIVIAGVSNREGGAGAITSTGPVTDYAVFNNIKAMLPYLQEALKLTQRNHTLSDSLQAKATGSQNNRELAKNIYALAQNQKQILSNASSIFNLFNSIPKDQLKYLEKAYLKVPHLGQTPTNPYRQEVNLNQEVQTIKNNVSYYGNRIDSALSVARDVYNLKSNQTEIVTTYNDAKTLSEEISKLPYNKVNVTNIVMSPKDSTAGQYNYQINPEQQSNLNQALAAMSNNPFKKVGMISSQNNNGAMNGLGVQVGYKQFFGESKRWGLRYYGFFDYNHGYIKSSFFNSSSDIWTYGGGSDLLVNIINDSITRKNNKLSVGLFGGIQLAGTTWLNSQYVNLTAFNNPYSAKVNTSNFQFLFNLGLRTNLATAKKKDSEHSAQHGIELGIKIPTINTNYYSFLGTQLQYRRLYSVYLNYVFAY

SEQ ID NO: 22684 - protein, 651 aa, Helicobacter pylori J99
MKKTILLSLSLASSLLRAEDNGFFVSAGYQIGEAVQMVKNTGELKNLNEKYEQLSQYLNQVASLKQSIQNANNIELVNSSLNYLKSFTNNNYNSTTQSPIFNAVQAVITSVLGFWSLYAGNYFTFFVGNKNAKRPANVQGNPPFGTIVSNCSGIENCAMDQTTYDKMKNLAESLQAAQTNSTTKANNLCALSGCAATDSTSNPPNSTVSKALNLAQQLMDLIANTRTAMMWKNIVISGVSNASGAITSTGYPTQYAVFNNIKAMIPILQQAVTLSQSNHTLSASLQAQATGSQTNREFAKDIYALAQNQKQVISYAKDIFNLFNSIPAEQYKYLEKAYLKIPNAGQTPTNPYRQVVNLNQEVQTIKNNVSYYGNRVDAALSVARDVYNLKSNQANIVTAYSNAKNLSEEISKLPHNQVNTKDIVTLPYDKNAPAAGQYNYQINPEQQSNLNQALAAMSNNPFKKVGMISSQNNNGALNGLGVQVGYKQFFGESKRWGLRYYGFFDYNHGYIKSSFFNSSSDIWTYGGGSDLLVNIINDSITRKNNKLSVGLFGGIQLAGTTWLNSQYVNLTAFNNPYSAKVNTSNFQFLFNLGLRTNLATARKKDSEHSAQHGIELGIKIPTITTNYYSFLGTQLQYRRLYSVYLNYVFAY

SEQ ID NO: 22685 - protein, 660 aa, Helicobacter pylori J99
MRKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLNNVKLSFTDAQGNVIDLGVIETIPKHSKIVLPGEAFDSLKEAFDKIDPYTFFFPKFEATSTSVSDANTQRVFETLNKIKTNLIMKYSNENPNNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIDIDAVVLKNSGVVGLANGYGNDGEYGTLGVEAYALEPPQLFGNNLKTINLADLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQRNFTSSFGIFGGLRGVYNSYYVFNKVKGSGNLDVATGLNDRYKHSKYSLGISIPLVRRKASVVSSGSDYTNSFVFNEGASHFKVFPNYGWVF

SEQ ID NO: 22686 - protein, 270 aa, Helicobacter pylori J99
MKKFVALGLLSAVLSSSLLAEGDGVYIGTNYQLGQARLNSNIYNTGDCTGSVVGCPPGLTANKHNPGGTNINWHAKYANGALNGFGLNVGYKKFFQFKSLDMTSKWFGFRVYGLFDYGHADLGKQVYAPNKIQLDMVSWGVGSDLLADIIDKDNASFGIFGGVAIGGNTWKSSAANYWKEQIIEAKGPDVCTPTYCNPNAPYSTNTSTVAFQVWLNFGVRANIYKHNGVEFGVRVPLLINKFLSAGPNATNLYYHLKRDYSLYLGYNYTF

SEQ ID NO: 22687 - protein, 767 aa, Helicobacter pylori J99
MKRILVSLAVLSHSAHAVKTHNLERVEASGVANDKEAPLSWRSKEVRNYMGSRTVISNKQLTKSANQSIEEALQNVPGVHIRNATGIGAVPSFSVRGFGGGSSGHSNTAMVLVNGIPIYVAPYVDISIPIFPVTFQSVDRISVTKGGESVRYGPNVFGGVINVITKGIPTKWESQVSERATFWGKSENGGFFNQNSKNLDKSLANNMLFDTYLRTGGMMNKHFGIQAQANWLKGQGFRYNSPTNIQNYMLDSLYQINESNKITAFFQYYNYFMADPGSLGIEAYNQNRFQNNRPNNNKSGRAKRWGAVYQNFFGDTDKIGGDFTFSYYGHDMSRDFQFDSNFLNVNTNPKLGPVYTDQNYAGFFIFDHLRRYIMNAFEPNLNLVVNTSKVKQTFNVGMRFMTMDMYFRLDQSTCEKADIFNGVCRMPPFVLSKKPSNNQNLFNNYTAVWLSDKIELFDSKLVITPGLRYTFLNYNNKEPEKHDFSVWKTTKKRQNEWSPALNIGYKPMENWIWYANYRRSFIPPQHTMLGITRTNYNQIFNEIEVGQRYSYKNLLSFNTNYFVIFANRYYAGGYSPQPINARSQGVELELYYAPIRGLQFHVAYTYIDARITSNADDIAYYFTGIVNKPFDIKGKRLPYVSPNQFIFDMMYTYKHTTFGISSYFYSRAYSSMLNQAKSQTVCLPLNPEYTGGLEYGCNSVGLLPLYFVLNVQVSSVLWQSGRHKITGSLQINNLFNMKYYFRGIGTSPTGREPAPGRSITAYLNYEF

SEQ ID NO: 22688 - protein, 270 aa, Helicobacter pylori J99
MKKFVVFKTLCLSVVLGNSLLATEGSTEVQKQLEKPKEYKAVKGEKNAWYLGISYQVGQASQSVKNPPKSSEFNYPKFPVGKTDYLAVMQGLGLTVGYKQFFGEKRWFGARYYGFMDYGHAVFGANALTSDNGGACKLNEPCATKVGTMGNLSDMFTYGVGIDTLYNVINKEDATLGFFFGAQIAGNSWGNTTGAFLETKSPYKHTSYSLDPAIFQFLFNLGIRTHIGRHQEFDFGVKIPTINVYYFNHGNLSFTYRRQYSLYVGYRYNF

SEQ ID NO: 22689 - protein, 377 aa, Helicobacter pylori J99
MKKVLLGTTAIVAAGMIASSPASAAEKISAKVGGYMEQWIGYATVDQSGSTRDIDGFDIKSDSEIHFTGMTTLDNGIEFGVNVQLEANSNSGDQIDESYLIVKGSFGEINLGSENSAMYKMHYAPTDYGIGINSGDQIDWAAVSGSGITTSGYFRNPYGSTYVEPGQANDSEKLTYYTPRFGGFQIGLSYSPDSNQDNNNSPDRNASATDMVAVGANFKGDFAGASLGISGGYGKFLNSATGSTVEPEAYNFGLTIGFGGFAVGGSYAKADDNNNGSDGDGYNIGVAYTTGPLGVSLTYFDGERDGLTTGSGTTRVTTNSASQKTVHLSANYTLGPGVTAAATLGHANFESNDRTLAGATVQDIEATYFVTGIKLSF

SEQ ID NO: 22690 - protein, 872 aa, Helicobacter pylori J99
MTYRHERRCRTGTALMAGGMALAASAFGHAQPGYEFDDRLLLGSSLGGGDLSRFNQDGRIDPGRYHVDVYLNERFASRSEVSFRANPASGAVEPCLDEDFLRQRLGAKPGDDPRKSGDGRHCAFLGARLPGSRFSLDVARLRLDLSVPQALLDLKPRGYVSPEEWDAGDSMGFVNYDTNLYRSEYRGGESGRSDYAYVGLNSGINLGLWRLRHQSNYTYSRYNGQARRKWNSIRTYAQRALPAWRSELTAGESYTAGNLLGSIGYRGLSLATDDRMLPESLRRYAPQVRGTAATAARVVISQNGRKIREVNVAPGPFVIDDLYDSAYAGDLDVQVFEADGSVSSFSVPFASVPESMRPGLSRYSFTLGQARQYGDGDDLFADFTYQRGMSNALTANLGLRVADDYLAMLGGGVLATRFGAFGLNSTYSSARVEDGARKQGWRIGLDYSRTFQPTGTTLTLAGYRYSTEGYRELGDVLGSRDALRHGDTWDSGSYKQRNQFNLLVSQALGGYGNLYLSGSSSDFYDGKSRDTQLQFGYSNTWGQLSYNLAWSRQTTTYYQEQGDQDPGVELLRRDRRSGQRNDTLTLSVSMPLGSSSRAPTLSAMATRRSGDSRGGSLQTGLNGTLGDERTWSYALSANRDSEVADTTWNGTLQKQAALATVNAGYAQGDRYRQYSGGIRGALVAHRDGLTLGPSVGDTFALVEAKGASGAAIRGGQGARIDGNGYALAPSLSPYRYNPISLDPVGIDPDAELLETERKVAPYAGASVRVTFRTLTGHPLLIQARREDGSVLPLGAVVVDDGGAAIGMVGQGGQVYARAENQRGRLLVQWGTARKERCELPYDLAGVSRDQALIRLRGTCRAATTDSNLENAR

SEQ ID NO: 22691 - protein, 189 aa, Helicobacter pylori J99
MKKIAFILALWVGLLGAFEPKKSHIYFGAMVGLAPIKITPKPASDSSYTAFLWGAKGGYQFAFFKALALRGEFSYLMAIKPTALHTINTSLLSLNIDVLSDFYTYKKYSFGVYGGLGIGYFYQNNHLGMKNSSFMGYNGLFNVGLGSTIDRHHRVELGAKIPFSKTRNSFKNPYFLESVFIHASYSYAF

SEQ ID NO: 22692 - protein, 366 aa, Helicobacter pylori J99
MQFQKTLLSLSLLFLSYCIAEENGAYASVGFEYSISHAVEHNNPFLNQERIQTISNAQNKIYKLNQVKNEITNMPNTFNYINNALKNNAKLTPTEKQAETYYLQSTLQNIEKIVMLSGGVASNPKLVQALEKMQEPITNPLELVENLKNLELQFSQSQNSMLSSLSSQIAQISNSLNALDPSSYSKNVSSMYGVGLSVGYKHFFTKKKNQGFRYYLFYDYGYTNFGFVGNGFDGLGKMNNHLYGLGIDYLFNFIDNAQKHSSVGFYVGFALAGSSWVGSGLGMWVSQMDFINNYLTDYRAKMHTSFFQIPLNFGVRVNVDRHNGFEMGLKIPLAVNSFYETHGKGLNASLFFKRLVMFNVSYVYSF

SEQ ID NO: 22693 - protein, 1132 aa, Helicobacter pylori J99
MKLKYLLAASAAGLTTAVVLPAPVAAQQITSGVEGTVTDDTGTPLAGATVVVTDTRTGQSRTLTTGADGSFRATSLVPGGPYTVTATAAGYEGQTIEDQFINISGNTDYTFTLNDASAGGDNLIVVTAERVNVQQLAVGPGTAFGETTLESFPSISRDVRDIIRLDPRVSLERDNEVDRISCLGGNDRSNTFTVDGIVQADVFGLNGTPFAARNSLPLPFDVVRETSVEFAPFDVEYSDFTGCLVNVVTKSGTNKFSGSAFYTFFNDDLLADTIIDGDGVEQPLSSGSEKRWGATLGGPIIPDRLFFYLGYEETDLGDANDFGPAGGGFANEAEFVTQAQFDQFAQIASSVYGQDVGGYPRTLPETSVRYFGRIDAYITDDHRLEATYQRLEESNVESDFGPDNLTGLNSFEDEGTISDYYSVRLYSEWSDKISTEVRLSRSEVGDIQGPVGFGEAQAANPTVRLAVGVTGPTGENGILSTGPGIFRSANQLDTKIDQAKLQMNINGGDHQFKIGAEVNDLEVFNLFAINATGTIFFRNLTDFQNGVIAPGFFSSVFGSADDLANGALGGATIAATPTGDINEAAATFKRTIWSFYAQDEWQATDQLSITAGLRAQFYSGDAPRHNPQFEARYGFTNANSFGKLDTVLLPRLAATYEFDNTGFFSNSRVTGGVGMFSGGDPVVYFSNAFSNNGFSTGNGESFDCAVVPTSVVSGGQFTGFPGCVAALGSAQAAAGLSDTQSTDPDFDVPTVVRANVGFATDFGAESGFFSDWRLNVDYIYSRFNDTLNFVDLSQTPDIRRGLNGFTVDGRPIYAAIDPTAAGCNAVLQGTGGTPPVWSGVTPACFNTRRDDEIQLTNGPSYESHIASVLLSKNFNRGIFTEGGSIGLRLGYAFTDSNNNRNVGSSTATSSYDVSAAFDRQNPAVSTSNYETRHNITASVFFREEFFGDYQTSLGVFFRARSGRPYSLTFDGGGVFNDSSSGTDNALLYIPSGAGDPNVSPSSDPAAVQSLIDYVGTTNCKFTPGQSIERNTCSNPWHYDLDLRFSQELPFIGSLTGLVNDRIELFADFDNFLNLIDSSANRLKFQSEFTDVVDGGVDAQGRYIISGFRPDDDQFVAISSSAWKIQVGVRYEF

SEQ ID NO: 22694 - protein, 289 aa, Helicobacter pylori J99
MGINMCSKKIRNFILCFGFILSLHAEENTAQESMTEENMIKENTSKDAPILLEEKRAQTLEFEENKEVKKNIDEKSLLEEIHKKKRQLYMLKGELHEKNESLLFQQMAKNKSGFFIGVILGDIGVSAHPYEKFEPLSNIQASPLLYGLRSGYQKYFANGISALRFYGEYLGGAMKGFKSDSLASYQTASLNIDLLMDKPIDKEKRFALGIFGGVGVGWNGMYQNLKEIRGYSQPNAFGLVLNLGVSMTLNLKHRFELALKMPPLKETSQTFLYYFKSTNIYYISYNYLL

SEQ ID NO: 22695 - protein, 216 aa, Helicobacter pylori J99
MGLIMKKLTALVLAAATLAPAASFAHEAGDFIFRAGTATVRPNAGSDDVLGGLGHFNANNNTQLGLTFSYMVTDNIGVELLAATPFEHKVSLGELGNIATVHHLPPTLMAQYYFGSKEDKLRPYLGAGINYTFFFDEKFNSGAKQLGLSDLDLSSSWGFAAQAGMDYMLTENWMLNASLWWMDIDTDVKFKFNGAQQKVDTRLDPFVFMFGVGYRF

SEQ ID NO: 22696 - protein, 245 aa, Helicobacter pylori J99
MRTLLKMLVGTSLLTHALVAKEESAAPSWTKNLYMGFNYQTGSINLMTNIHEVREVTNYQTGYTNIITSVNSVRKLTNMGSNGIGLVMGYNHFFHPDKILGLRYFAFLDWQGYGMRYPKGYYGGNNMITYGVGVDAVWNFFQGSFYQDDISVDIGVFGGIAIAGNSWYIGSKGQELLGITNSSAVDNTSFQFLFNFGLKALFVDEHEFEIGFKFPTINNKYYTTDALKVQMRRVFAFYVGYNYHF

SEQ ID NO: 22697 - protein, 862 aa, Helicobacter pylori J99
MKQFAFTPSLIAGATLALTAGFTTTTYAADEVKKVERIEVTGSRIKRSDMEGPSPVQSISRADIDNMGYDNLQQLLERMPVAGSGTFSTRGNNQDSTANGSAAVSLRGLGADATLVLINGRRVAISAFAEGITNSFVDINSIPVSAIERIDILKDGASAIYGSDAVAGVVNVILKKDIDGIEVNLGYGGTDGPNYEETSASIVWGTSNEKSSASVIIDYFKNTSLSSSEMGSLGTADQRALGGEDFRSSRGFPGYFYVDGVKTIDPACPADSATASGSCLFDYGPYGYIAPASERIGAISQFEYNFDNGITAFLEMAVQHNSSVAMGAPTPLDEDAGLTVPANHPNNPFGKDIDIGRYRTVDAGARQWDIESDTMRFVAGLRGEFNDWSWETAVQKGRSKSMQTGDRSQGWVRTDFLQQEIDAGNYNPFGGTYNDPAVIDRITTSLVRQGESHMTSFDANISGEAFSFGDDVVMMAAGIEYREEDVTDIPDDQFRRGLIFGTEAVSAAASRDQYAAYVEFSIPLADTLELQLAGRHDDYSDFGTTTNPKVALRWAPSDEITVRGSWAQGFRAPSLAQVGLGPSEKSQFFIDTQRCQQTGLDCQALDYNIQFSGNADLQPEESESWNVGFIWAPSAEFGLSVDVWSITQDNKIDQEEFGPIYAAECGNQNSTVCVRLPPTNGESLGSIQKIYSTFENVSSQEVSGIDFSANYNHSLDDLGLLKFNLEWAYQNKFEKDGRDYSGEYGYPEHRWIFSTNWEVGDFNTNVNLSYVGEFEDTPDIDFDGNLDFDSNTSRMIDSQVLVDLQTSYRITESAKLSLGINNLFDEEPPFAIGDGDSDLYGYASGVHNPRGRYIYTKVSFSF

SEQ ID NO: 22698 - protein, 472 aa, Helicobacter pylori J99
MKNTNTKEIKNTRMKKGYSQYHALKKGLLKTALLFSLPLSMALAEDDGFYMGVGYQIGGAQQNINNKGSTLRNNVIDDFRQVGVGMAGGNGLLALATNTTMDALLGIGNQIVNTNTTVGNNNAELTQFKKILPQIERRFETNKNAYSVQALQVYLSNVLYNLVNNSNNGSNNGVVPEYVGIIKVLYNSQNEFSLLATESVALLNALTRVNLDSNSVFLKGLLAQMQLFNDTSSAKLGQIAENLNKSGGAGAMLQKDVKTISDRIATYQENLKQLGGMLNNYDEPYLPQFGPGKSSQHGVINGFGIQVGYKQFFGSKRNIGLRYYAFFDYGFTQLGSLNSAVKANIFTYGAGTDFLWNIFRRVFSDQSLNVGVFGGIQIAGNTWDSSLRGQIENSFKEYPTPTNFQFLFNLGLRAHFASTMHRRFLSSSQSIQHGMEFGVKIPAINQRYLKANGADVDYRRLYAFYINYTIGF

SEQ ID NO: 22699 - protein, 487 aa, Helicobacter pylori J99
MKNHSFKKTIALSLLASMSLCNAEEDGAFFVIDYQTSLARQELKNPGFTQAQELKQLIRDGAVRLQTSAIPLSYYLDILGNKTKILLSESLKNNAQPSQQNAQPPQQNGQPNQALVNLERSLGILGKLLELSQQYASEGVIKPLVVDVGNKQIGITDSMLLVAQNIVLALGQVDLSKIQQNNNQQLYENIMKVMLLGAGGTNGAYNGVSVGDIATGMQNFSSQTGLIGANSTVSELNALIKSGISLDRETLRLGSFIEKNICSSASSCFSGSQLIYKKGLDRVINIINASLGQFESSASSLYKISYIPNLFSLKDYQSASMNGFGAKMGYKQFFTHKKNVGLRYYGFLDYGYANFGDTNLKVGANLVTYGVGTDFLYNVYERSRRRERTTIGLFFGAQIAGQTWSTNVTNLLSGQRPDVKSSSFQFLFDLGVRTNFAKTNFNKHRLDQGIEFGVKIPVIAHKYFATQGSSASYMRNFSFYVGYSVGF

SEQ ID NO: 22700 - protein, 486 aa, Helicobacter pylori J99
MKKTILLSLMASSLLAENDGVFMSVGYQIGEAVQQVKNTGEIQKVSNAYENLNNLLTRYNELKQTASNTNSSTAQAINNLKESASRLKTTPNTANQAVSSALSSAVGMWQVVASNLASGTLSTSEYNKINAISQLLQNTLENKNTANNNTTIDNDASKLLDDAKTIISTLQSQCPGIDGGNGKPWGINASGNACNIFGNTFSAITSMIDSAKKAAAEARRTDPEGPNQPSAFTNADFNKNLNQVSSVINDTISYLKGDNLATIYNTLQKTPGSKGFHSLVSRSSYSYSLNETQYSEFQTTTKEFGLNPFRSVGLINSQSNNGAMNGVGVQLGYKQFFGKNKFFGIRYYGFFDYNHAYIKSNFFNSASNVFTYGAGSDLLLNFINGGSDKNRKISFGIFGGIALAGTTWLNNQSANLKITNSAYSAKINNTNFQFLFNTGLRLQGIHHGIELGVKIPTINTNYYSFMGAKLAFRRLYSVYFNYVLAY

SEQ ID NO: 22701 - protein, 253 aa, Helicobacter pylori J99
MKTLFSIYLFLSLNPLFLEANEITWSKFLENFKNKNEDDKPKPLIIEKNNEKQKILDKNQQILKRALEKSLKFFFIFGYNYSQATFSTSNQTLTLVANSIGFNTATGLEHFLRNHPKVGFRIFSVYNYFHSVSLSQPQTLMVQNYGGALDFSWIFVDKNIYRFRSYLGIALEQGVLLVDTIKPGAITTIIPRTKKTFFQAPLRFGFIVDFIGYLSLQLGIEIPLVRNVFYTYNNHQERFKPRFNANLSLIVSF

SEQ ID NO: 22702 - protein, 255 aa, Helicobacter pylori J99
MKKIFLGMALAFSVSMAEKSGAFLGGGFQYSNLENQNTTRTPGANNNTPIDTSMFGSNQVAPAQETPSVINTNNYGQMYGVDAMAGYKWFFGKTKRFGFRSYGYYSYNHANLSFVGSQLGIMEGASQVNDFTYGVGFDVLYNFYESKEGYNTAGLFLGFGLGGDSFIVQGESYLKSQMHICNNTAGCSASMNTSYFQMPVEFGFRSNFSKHSGIEVGFKLPLFTNQFYKERGVDGSVDVFYKRNFSIYFNYMINF

SEQ ID NO: 22703 - protein, 662 aa, Helicobacter pylori J99
MKKKFLLMVVLGMLIVQSIFGEEKTIILEQTVVSAESFGTSSRKIAKNIRIITKKEIEETGALTVEDSLKGVPGVIIRKLDGAPPIVDLRGSGMASSLTSTLLLLNGVPLSGIRSFDINSIPVSEIEKIEIIQGGGALMYGDGAAGGIVNIITQPLKNKKYYGNIGLEYGSWKTRRTNFRMGSQLGKGFSIQTSYSGYSSMDYRDRAYGTDFSGKNFDYRNSKDRSESIWVSGRKELENGNIELRYNHIKNKDYFTTYLEKEQYIENPKQMGITGSYIQDKTDIWNLSYNKRLKNNIDFLFNGGYHYGKNENQNFKIQEYFVTPQIKYTYGNKSYFIIGGDIRNGKREFKNTILLNGKNAPDDIRKSKAIYIMNKYSIGNLEFSQGYRREKVSYDYTSKVFGHVWNLLATNPVSSSSSNNNSLELGINYLYSNTGNIYFNYTNSMRTPSIVDMEAWTGDVKTKKEKIYEIGLRDYIYNTLLTSSVFLMDSQNEVYYDKTELFKVKTKNFDGKIRRVGAQLALIHYFDKLTLRENISFINPKIKSGEYKGKIFPTVPNLIVNMGATYHFTEQFNINTDLYYQSKAYADDDFNNNFEKENSYATLNINFSYKFNNGIELYGGVKNLFDKKYADSVAIMKSHFGSRSVYYPAEGRNIYAGFKYQF

SEQ ID NO: 22704 - protein, 1053 aa, Helicobacter pylori J99
MKKTLLLLFVCLFVGISHAQAQVTVKGTVISSENNEPVIGASVLVKGTTNGTITDINGQFTLTNISPTNKTIIVSFIGMETQEVTIKPEMKIVMTSTTEVMEEVLVVAYGTAKKSAFTGSAKMIHTEQITKRPVTNVIESLSGQVAGLQMTMTNGQPGETPSILIRGISSMSAKTDPLIVLDGMPYEGGWNNINPADVESISVLKDAASTALYGARGANGVIIITTKSAKAGDAKITVDAKWSANTRGEIEYDYIKDPGEYYQAHYKALYNYYLNAQGQTPDQAYVSANTNMIGTNSQTGGLSYNVYSYPEGEYLIGKNGLLNPNAKLGRIVNGYYLTPDNWVDAVYHTALRQEYNVNISGGSDKAQIYASFGYLDEDGIAEGSDYSRITGRLKTTYQAKPWMRFGANISYTHSIQNSAAGGFSQAFNTAPIYPLYLRDTNGKIMQDKNGDMYDFGVSNQGPLNRPINPNSNGIKLSQLDTYNTSANTLNGDAFIDVNFLKDFKFTFNAGTSIRDSRYKNALNPFYGTANSLNGSINVQHWRRTTLNLQQILNYNHSFGLHNVSLMAGHESFNNVYEELYAAKNSMFSFFQNQELNGAISGTNDESSYKSKYNTEGYLFRGMYDYDGKYFFQLSYRRDASSRFHPDNRWGNFYSVGTAWILTKEKWLDDIKWLDLLKLKFSVGQQGNDRIDDFLYVDTYNINNSNNELSLGFSRKGNKNITWETNTNINLGIEFELLKGRLSGSIEYFNRRTTDMLNRFSVPLSLGYSGYYDNIGDMNNKGVEIDLKYIPVKTRNVTWNIGFNATHYRNKISRLAESKKTDIIDGHAGYVNGLYYYGEGLPMYTNYVQKYAGVSEEGKPQWYYTDKQTGEMKTTTTYSQADLYLCGDAVPDLYGGINTSLSFYGFDFSTQINYSIGGQAYDYGYQALMSPPTSTHLGYNVHKDIYKAWSPENTQSDIPQWQFNDLYSVKTSDRFLTNASSISIQNIQLGYTFSKKTLRSLYLTNLRIYVACDNVYYWSKRKGFDSRVTWNGNKDSSGEYSAVRAFSAGLSLQF

SEQ ID NO: 22705 - protein, 202 aa, Pseudomonas fluorescens
MKTTKLFVSSVVALALSSSALVAEESGVFVGVGVGYGGSQIKAGSEKQNLSGISYEVIAGYKQFFTQDFGLRYYANFAYADASKKASGGDKITGNVMDYGVNVDALYNFISGDTSFGAFLGLGLGANSWGGKTFKDDKMDKTGLNLALNVGLRTEIAKAHGIEIAARVPFIATTLQKADAAGNPKVTASHTYNAGVRYIFSF

SEQ ID NO: 22706 - protein, 680 aa, Pseudomonas fluorescens
MITDPVEAASSIQAETTSAYKEKQTTENKALLRPKDITVTAKRPISTQASSSTHISAEDMQAYRMQTVSDIAERVPNLSFTSMTPSNPVVTVRGMGSSEDHGSSSYTPILIDGVSVPSFALGQIFDLSDVDVMRGAQITEGINAFAGLISAHSHDPGDKLSASASFEYGTGNRKRGSFTADIPVNDSTSIRLALGGETADGYIHNKVLDKHNTGGWHSWWGRLKILHTDSSGGEWRISLHHMINHGGNDYFEMPENAKKHISYSTDQGKNDTEYLLGSLQYHRSFSEHLNIDAMFGGVGTKWKYWNPRSVFNAVSGNSAPTQQIGGSLMLSGTFGKLDWKGGVYGQRALRSSPYDFDMSPYYISHTTADLGTTEIAFMGELGWHFAQNWKLVPSIRVEHVDSSLKNWTSSISGDVPTAFSMYQSLPDQTISKTVPLPGVKLEYSPKNFSSLRQFMWLSYTRSFLAPGYNPFSNYAETASVPYSSSYGNNIELGYRVGDKKNIWSIEVVGFSNFLSNLQVAATSKLGETVVATAKKAHSRGMEATVHWRPIHNFQLNGFVGLTYAAYDRFIYGGKDYSGELMDSTPISNFGFSGAWTPIKDLTVNASIIRRGRSTLHPSSNVENDPYLLMDAQIEKRWKHWSIAIYGHNLTDSGYYTRGVPSGRVVAANPRQIGLRAGVSF

SEQ ID NO: 22707 - protein, 979 aa, Vibrio orientalis
MTVKGLMRASSALTALAMVAGLSATSYAQDDVIIVTGSVIRGTPEDAALPVDVLSAEELARLGNPSPVELIKALPVSSGVIGDTNQFDSRSQATEGMASVNLRGLSPQRTLVLLNNRRLVPAGTGVPFVDLNLLPAAAIGRIEILKDGAAAIYGSDAIGGVVNFITRSDQEGFRFGGDYSFISDTDGDYTLQGSFGHQGDNFRLMVAAGYQHRSELLAMDRDFAVQDFEANPEGGWTGGGNPATFLPLGIIPGVGVAPIGGLRADPDCAALGGFVTAANWCRTQYTGFDALVEEEDRYQIWGEMGIDLTDNVEWEISLLYGSDEVPHYRTSPMYLLTQAPSASVGGSPSGFIVPGNNPGFIQMVTENPGVVPAGTIAALFPTLLFRPLLAGGNPAFAGRPDDLGSAVGLRENESFRISTGLNGELNDTTSFDVNLTYHRYERFYDGYDSFGDRVQLALGGLGGPNCNPATGTPGVGDCMWYNPFGNQAPANAVTGVERPGAEPNQNSAELINWFFVRGSTRLETELFVAEATLSGETGWELAGGSVLYGFGGQYRRETYSAAYGDNNNIAVNPCRDTPVSGNTTCDPQTGAWAFLGSNADSDADGDVYAIFGELQLPVTDDFNVQLAARYEDYGGQTGSTFDPKVTARWQISEGFALRGSAGTTFRGPPAQQTVNSNVTSLQVIASSFRPVDVFGNPGLAPESATNYSIGALFSTDNFTASVDYFRYEIQDTINTEPLSGMVATLFADPANCTDPTFDGLRERFQFNDGGGVAGAGTCAAANIARVRTEVVNGGDLTSSGVDFILNYDFGDVMGGTLNTGLTATYMLGNELGDETVEGVVVQQGFDGVGFMNFQTTAYPVPEWKARGFFEYTVGNIDTRLTFTYTDSYRDQRADLGTGPFAPNPYIVGNPTLMQGATIDSQLTTDFNLLYHFGDATTFSFTAINLTDEDPSFSRQDYNYDPFTGNPVGRVIRVGFNTEF

SEQ ID NO: 22708 - protein, 290 aa, Acinetobacter sp.
MRHERFNFSVDEFTPLLDNNFDPYVGPSVAGGELDFSDTVFNVGSVYKITPTVSVFANFAQGYSVPQLFRVLNFLPPGFTIDRDVRFLQPQKIDNYEIGVRGNWNNFQATLAGFFNYSALGLSSRGQPDGTIQYIRAPQRNYGIEATLDWQPSNKWKLGSSLTWTEGEDDQNEDGDFRALRTLEVQPLKLTAYVENQTTPGWRNRLQLLYVGNRNRGFEAGSDFVTIRDYLVVDYISSFQIGAGNLEVGIQNLFNNKYSSVFSQAGGGLDELLYNLERGRSLSVNYRISW

SEQ ID NO: 22709 - protein, 221 aa, Rhizobium meliloti
MGNLALKLGYIHRDNKNRIMLKKESAKSFYINGHNFGVDIYTFQLNNIEPWKLGKTYWTTSLGFDWLNTKRADVSNEFNPNDPVYLDGKLMTRSQMLQQVNSSTEDWITRLGIDMEMPDYNITWSNKVYMKAPIRSYEELDSDNNDISRFRSYHYGRHTQWDSSIRWQPTIRGKHSVYLQVDILNVLNKTRKNKVTTISTSDEYGVYTPGREFWLEVGYQF

SEQ ID NO: 22710 - protein, 211 aa, Rhizobium leguminosarum bv. viciae
MRVLIAGLMASVFAIAGVSAAQAADAVDQVPEAPVAQEAPVKPAGNWEGFYLGGAGTYNMGDFGSDRHTYGFGGQVFTGYNWQQGQIVYGVESDLGYSGDDVSSGGVKNKYGWNGSVRGRVGYDMNPFLLYGTAGLAIGDVKVSDDTSDESKTNFGYTVGAGVEAFVTNNITTRLEYRYTDYQSKDYDLDSGSFSRGYDENSVKLGIGVKF

SEQ ID NO: 22711 - protein, 1295 aa, Escherichia coli O6
MNKIYSLKYSAATGGLIAVSELAKRVSGKTNRKLVATMLSLAVAGTVNAANIDISNVWARDYLDLAQNKGIFQPGATDVTITLKNGDKFSFHNLSIPDFSGAAASGAATAIGGSYSVTVAHNKKNPQAAETQVYAQSSYKVVDRRNSNDFEIQRLNKFVVETVGATPAETNPTTYSDALERYGIVTSDGSKKIIGFRAGSGGTSFINGESKISTNSAYSHDLLSASLFEVTQWDSYGMMIYKNDKTFRNLEIFGDSGSGAYLYDNKLEKWVLVGTTHGIASVNGDQLTWITKYNDKLVSELKDTYSHKINLNGNNVTIKNTDITLHQNNADTTGTQEKITKDKDIVFTNGGDVLFKDNLDFGSGGIIFDEGHEYNINGQGFTFKGAGIDIGKESIVNWNALYSSDDVLHKIGPGTLNVQKKQGANIKIGEGNVILNEEGTFNNIYLASGNGKVILNKDNSLGNDQYAGIFFTKRGGTLDLNGHNQTFTRIAATDDGTTITNSDTTKEAVLAINNEDSYIYHGNINGNIKLTHNINSQDKKTNAKLILDGSVNTKNDVEVSNASLTMQGHATEHAIFRSTANHCSLVFLCGTDWVTVLKETESSYNKKFNSDYKSNNQQTSFDQPNWKTGVFKFDTLHLNNADFSISRNANVEGNISANKSAITIGDKNAYIDNLAGKNITNNGFDFKQTISTNLSIGETKFTGGITAHNSQIAIGDQAVVTFNGATFLDNTPISIDKGAKVIAQNSMFTTKGIDISGELTMMGIPEQNSKTVTPGLHYAADGFRLSGGNANFIARNMASVTGNIYADDAATITLGQPETETPTISSAYQAWAETLLYGFDTAYRGAITAPKATVSMNNAIWHLNSQSSINRLETKDSMVRFTGDNGKFTTLTVDNLTIDDSAFVLRANLAQADQLVVNKSLSGKNNLLLVDFIEKNGNSNGLNIDLVSAPKGTAVDVFKATTRSIGFSDVTPVIEQKNDTDKATWTLIGYKSVANADAAKKATLLMSGGYKAFLAEVNNLNKRMGDLRDINGESGAWARIMSGTGSAGGGFSDNYTHVQVGADNKHELDGLDLFTGVTMTYTDSHAGSDAFSGETKSVGAGLYASAMFESGAYIDLIGKYVHHDNEYTATFAGLVTRDYSSHSWYAGAEVGYRYHVTDSAWIEPQAELVYGAVSGKQFSWKDQGMNLTMKDKDFNPLIGRTGVDVGKSFSGKDWKVTARAGLGYQFDLFANGETVLRDASGEKRIKGEKDGRMLMNVGLNAEIRDNLRFGLEFEKSAFGKYNVDNAINANFRYSF

SEQ ID NO: 22712 - protein, 1650 aa, Rickettsia conorii
MNKLTEQHLLKKSRFLKYSLLASISVGAAIPFEGMAMSKEAFRIDLSNKLLNHVSQLNGHKDTTNTPQQIGTVIVSEPEINTYTRSEIREMKISNKPKASNPLKDVPIEDHYKVVARSKSDVGKARKVRPITRCKTFAGIEKTEQSQNTYTPESTEQMPQKPEIIITASSPTVSPASNSFITAPNTPNTTLTSPEHYTTAPGTPSSTPATPYQSTSDSKPNDSLGANTPPNINTNSKAVRRLSFSSSDPQQQAVQSSSQVKSEVPPKPTFVPLPIKKSSTEIVAGMVSNISRVNEMIGIKLAEVTQAIKDTTDKKDKERLQKLYTQLTSTQKTTETLKSRAEEIETKIKIGENKDKIKKLEKELTSKNNKADRLFQKIEKIDILANKVSIKSQETVPVTTASTEVSAFQAQQARINEARQGVFNKNKSSGGNARKSSAGTKREKKKQEAQKQLSEIKKQEKAIKTASDKAKEVAASAKKETSRTALRAMQDKMNGDSEQLNKIEENLKLLTPDVYNSSTGPTYKQSPKAKPTIPLSHGVQRILGEQPEDEEGYLVPIKVQQQPYQEIEDPIPSHSKDIYEAKVSQYINYLNSIQPNQSNQAQIDSVIDGLATEMRKFSADQFSQKLGEIAHLASIKAYEGLFEKLYEVQQARILETQKVYEQAKISQSYAEYEENSRKSSTPVLSRSSSAKSVISSNFEEKSALLQTTTTDESLRSDNNWKNSAPYSSSPKLDKRGLEYLDLAGDAFVQNLKQPDTLTIETLGLITPTQNTTVAKSDSSRKNNVSGSISEMQQLQSEKMRTETLGVQDDLDVDASYNTAPPEVLKEAEALLDRSQGRLNLVDSTIKKGTQPLSNLSTIYESVSYENLASETIYKTEQPKPSISYTNTSKRKLPIPLFRSAELDKKLEYLDLEDKLLEVEEARIVKEKEAIAKLNQYQDPENLEFKRLAMEALDLSSKESQLKQKRKAIEAEFSLNEKSSSTDVSILRSYSIDDISGVLSDAESNLSRSPSVSGLEDLNNSNVMQLGELKSKHEKIANDYNKELELDTLNKEKIWLEGEIKHLDTESKPKVTESKPVFSCSSSVGSINSFSNDDDLSSRDVVTPVDTLNIEINKDYVDTYIRVLSNKIQKIEEIQKIEELSGSSSRSEELNHIKEAMAYISNRIQDVEELDEKMLLAINAQLQEHDEKISSLLREEATDILAQLLLQEMLVSDGKSESTLPAGDEEQEDTEVSRQLSSLPALASSNESALALSDDREKECLALGDSSEDEESYDSGFEEEEETIGQLSDSDGGNLKITEVDTVIPLEQEAKKEMQTQISENAPTLNQAKVVNTIVNNMIRNRLDSSMNMSNNMVAVGAGDEERSHIKRGLWMRGMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIKSNVKHRNHSYNAEALLHYNYLLQSKLVITPNIGLRYGKSRDGVYNETGVNVQEIALTMKENNILSGIVGTKVTVPLKDALKFNNLGLTFQGAVEHNFKEKTQRINRVVKIFDNTFKHNYLIPKQPKTSYNLGTGIIGSIKNTTISLDYNYYLNKHYRSHQGNVKLKVNMKGAA

SEQ ID NO: 22713 - protein, 1851 aa, Rickettsia felis
MNKLTEQHLLKKSRFLKYSLLASISVGAAIPFEGMAMSKEAFRIDLSNKLLNHVSQLNRHKDTTNTPQQIGTVIVSEPEINTYTPSEIREMKISNKPKAYNPLKDVPIEDHYKVVARSKSDVRKSRKVRPITRCKTFAGIEKTEQSQNTYTPESTEQMPQKPEIIITASSPTVSPASNSFITAPNTPNTTLTSPEHYTTAPGTPSSTPATPYQSTSDSKPNDSLGANTPPNINTNSKAARRLLFSSSDPQQQAVQSSSQVKSEVPPKPTFVPLPIKKSSTEIVAGMVSNISRVNEMIGIKLAEVTQAIKDTTDKKDKKRLQKLYTQLTSTQKTTETLKSRAEEIETKIKIGENKGKIKKLEKELTSKNNKADRLFQKIEKIDIPANKVSIKSQETVPVTTASTKVSAFQAQQARINEARQGVFNKNKLSGDNVRKSSAGTKREKKKQEAQKQLLEIKKQEKSIKTASDKAKEVAASAKKETSRTALRAMQDKMNGDSEQLNKIEENLKLLTPVVYNSSTGPTYKQSPKAKPTIPLSHGVQRILGEQPEDEEGYLVAIKVQQQPYQEIEDPIPSHSKDIYEAKVSQYINYLNSIQPNQSNQAQIDSVIDSLATEMRKFSADQFSQKLGEIAHLASIKAYEGLFDKLYEIQQARILETQKVYEQAEISQSYAEYEQNSRKSSTPVLSRSSSAKSVNFEEKSALLQTTTTDESLRSDNNWKNSAPYSSSPKLDKRGLEYLDLAGDAFVQNLKQPDTLTIETLGLITPTQNTTVAKSDSSRKNNVSGSISEIQQLQSEKMRTETLGVQDDLGLDLYYAPQDTLTEESTYLVSSKKKQGNIIKRALSKVDSILQTNYAENRRRKRDGETSKQRTVDQEGEFGHAWGNENHKESNLSVVSGCIEKATQLISLLDAKRTAILQTTSPSQRRSVSLVLQEIENDYREAIKVSQKLQQVLIRKPEDIKAYNAKAEKKLDAIKSRADKHFNNIETDVDVGFNPNGGNSHSMPTANMDSLPKNLAVTPPINVGSLYNSPQAQQFREDHKNIINDRSQGRLNLVDSTIKKGTQPLSNLSTIYESVSYENLASETIYKTEQPKPSISYTNTSKRKLPIPLFRSAELEKKLEYLDLEDKLLEVEEARIVKEKQAIAKLNQYQDPENLEFKRLAMEALDLSSKESQLKQKRKAIEAEFSLNEKSSSTDVSILRSYSIDDISGVLSDAESNLSRSPSVSGLEDLNNSNVMQLGELKSKHEKIANDYNKELELDTLNKEKILLEGKIKHLDTESKPEVTESKPVFSCSSSVGSINSFSNDDDLSSRDVVTPVDTLNIEINKDYVDTYIRVLSNKIQKIEELSGSSSRSEELNHIKEAMAYISNRIQDVEELDEKMLLAINAQLQEHDEKISSLLREEATDILAQLLLQEMLVSDGKSESTLPAGDEEQEDTEVSRQLSSLPALASSNESALALSDDREKECLALGDSSEDEESYDSGFEEEEETIGQLSDSDGGNLKITEVDTVIPLEQEAKKEMQTQISENAPTLNQAKVVNTIVNNMIRNRLDASMNMSNNMVAVGAGDEEESHIKRGLWMRGMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIKSNVKHRNHSYNAEALLHYNYLLQSKFVITPNIGLRYGKSRDGVYNETGVNVQEIALTMKENNILSGIVGTKVTVPLKDALKFNNLGLTFQGAVEHNFKEKTQRINRVVKIFDNTFKHNYLIPKQPKTSYNLGTGIIGSIKNTTISLDYNYYLNKHYRSHQGSVKLKVNL

SEQ ID NO: 22714 - protein, 1873 aa, Rickettsia conorii
MNLQNSHSKKYVLTFFMSTCLLTSSFLSTSARAASFKDLVSKTPAWAKHNSTQQQNIWKDLTPTEKIKKWQEAALVPSFTQAQNDLGIKYKETDLSSFLDNTRHKARQARAEILLYIERIKQQDFDTKKQAYINQGVVPTDIEAATNLGISYDPSKIDHNVEHDQKVRRAEKDKKAVIELYISSINRDIKYKHYVDNDIIPEMQEVRTALNMNKDDAQSFVASIRTEIMENAKGQYIADSHIPTEKELKKKFGISRDDNRDGYIKSIRLKVMENAKGQYIADSHIPTEKELEQKFGADKGEATNYIASIATQMMLGKKSYYIDNNIIPNTDELMNEFNIGPVKATSYINQIRAGIEAKQFLNNNDTTKPSTGHSQKKSGSKNDHWYMSNQSINDTGTSSRIFTGREKKQRYFFDPISTFKTHFNTKASKGNLTQSQHTIKRIIQQEENIAEFKNLIKTDPIAALTLQVGSSYKQEAVTTILSDFNDNTIQRVLFSNDKGQLDFKTNIDVKNRPILQELLENSSSEEKTKFAERIQDYATRNISHSQFEEKARLDLIKLAASKDKRSVENFLTLQLELKNRMQPYIVNSAYILTPEIVKEINIELKNKGLIRDSLTKDYMIKLAKEVNNHTLNSVIKVILSDSNILSNETNKILGLAVGNNANNLEQTQSGIPNPPPLPLNGDIPNPPPLPLNGDIPNPPPLPLNGDIPNPPPLPLNGSMPPPPPLHSQGFSSNSKHFDLNQLQTEYPHIHSLYIQFTHNTTVQSKAPLQPTASSATSTGRSTPETAYAKLYAEYRTETGGTKANDLQDQLIKRQADLTNVIRQILTESYANQGADEKTLVNLFSISTPEIAEKAKEAFNTLAQDQYIKDITVNGKKTITSEEIIKNLFNEDTDDAVKRILLSSCKISEELKRPIKLEFNKSALIRELQGKQNPFEQLEFAYINAKNFDQDIFSNRVDELINNPNILTIVQQANFLITEDTNLRKTINSDQAQAKLDDLRTAILNTIKFEELITTNLPQHDFIAIVKEKDPALLQEFLKATTLKLTGNNNLDQLRLALPSFADMSNEQIRILANKLKMPIILKAIQELKAIQECSQEKAKQHIHTENMPPPPPPPPLPNAHDLKLAYLTSLGITKFNANTSTFKTTPKTYHFSSDIALRYKEFTLSGQKSAGYKAKYSDADLLQKAIVESVAFEHSKNLSKAYQNNKYFEQIQEAVDTMHPRFIGPRTEIGQNIHNIYTSKLLELTKDKEFIKYVKDNIILSKKLTEVFTSADSDFIGPRTEIGQKIHDIYIQQLTKYPEEAVKEAFNTAHPDFIGPRTEIGQEVHNIYKSQLLELAKDKELFLFVQQVLVDSAELEQKYGSDIQSENSNDEKKVGRLDKTKLRLFQQENEATNDESSTKDDTQPEDSNKKSEQSDSKTALSPRLLSSNDSKNDKSSDYKKSLLALRSSDEDDQGYATGYTTDEEELEESNSTTGEELKKDISDYKKSLLALRSSDEDDQGYATDEEELEEGNSTTGEELKKDIVLESEDEAIDVSFKTEAITEQDKVTQRQQVSDDTSGKVAILVQATSTLHKPVHYNINDRLTVAAIGAGDEETSINRGVWISGLYGINKQSIWKNIPKYQNRTTGITIGADAEFINSHDVIGIAYSRLASQIKYNKKLGKTAVNGHLLSIYSLKELIKGFSLQTITSYGHNYIKNRSKNINNIIGKYQNNNLSVQTLLNYKYRTKYDLHFIPNIGFQYDYSRASNYKEYNVDIENLMIQKKSNQLFESSLGGKIVFKPIVTTNNIVLTPSLYGNIEHHFNNKNTKVNAKATFKGQTLQETIITLKQPKLGYNIGSNILMSRKNINVLLEYNYYTHRKYQSHQGLMKLKVNL

SEQ ID NO: 22715 - protein, 807 aa, Rickettsia felis
MSLQETSKKVLYFLILQLSFFSISNAQTSVTVSGLIKDKNTQSVLSFVNVVLKTEKDSTFVSGTVTNEEGRFSLSKIKSGNYYLEVSYIGYKTSKKSLFVGTLTEYLDIKNIEIEEKLTSLQEVLVTGKTAEINEKMDKKTFSLKDNISQSGGSVLQAMQNMPSVTVHDGKVQLRGNDKVTILIDGKQTALTGFGNQTGLDNIPASAIEKIEIINNPSAKYDANGNAGIINIIYKKNKKDGFNGKFGFTTGVGSLWVQKENLPTIRPQYTFTPKINPSVSLNYRKNKVNVFFQGDYLYAETLNKNEFVTRNYDNGDVINSQLKRNRNTHFTTLKSGFDYAINDQNSLTISGLFGSEKIIDRGDQPFFNNDFLQRNRLWQFLEDELKTTIMATASYQHKFSAAGHLLNIGFNYTFHREDEKYFYDNYLPTSTGTDAFKLLSDEQVYDFNFDYIKPLKYGRIETGIKFRNRNIPTNMQFIPGTNSVLDANAGGWATYKELIPAVYGNYIFENKKWEGELGLRIEYVKIQYDVNPNHIVYKSDVYNYTQPFPNLRLAYKISDNNKVSIFYNRRVDRPNEVDIRIFPKYDDAEIIKVGNPALRSQFTNSIELGYKKSWGKGSLYNAIYHQFADGTITRISSTVAPNHLIYATFQNVNKSYNTGVEMVLAQEISKLYAFNINLNAYKNQIDAFTVENKYPSTHTFSANKQEIFSGNLKINNTFHFPKNIDLQLTAIYLAPDIIPQGKIKSRFSLDFGLKKAIQKGKGELFFNATNLLNTMIIKKEINGQGFNYTSNDYYETQVLRLGYSYKF

SEQ ID NO: 22716 - protein, 1810 aa, Rickettsia sibirica
MSTCLFTSSFLSTSTRAASFKDLVSKTPTWQKHNAKQQQNIWKDFTPNEKIKKWQEANLIPSFTQAQDDLGIQYKETDLSSFLDNTRHKARQARAEILLYIQRIKQQDFDTKKQEYIKQGIVPTYMEAATILGISYDPSKIYDNVEKDQNVRRAEKDKKALIDLYISSIKRDIKYRHYVNNHIIPEIKEVKTALNMDKDDAESFVLSIRTEIMENAKEQYIADRHIPTEKELKNRFGISRDDNRDAYIKSIRLKVMDKEKPQYIAANSIPTEKELEQKFGCDKGEATNYIASIATQKMLNKKAYYIDNNIIPAVEELKQEFRIGKIKANSYIQQITDGINANQLLNNNNTTKPSTVGSTKKIETKSDNWYMSNQGINTTETSSVVTTGRKEKQSYYFDPISTFKAHFNNKENNGNLTQPQHNINRIIQQEENIEEFKNLIKTDPIAALNLTVDSSYKKEAVTSILSDFNDDTIQRVLFSDDMGQLDFKTNIDVKNRPILKALLENSSSEEKTKFAERIQDYATRNISNSQFEEKARLDLIKLAASKDRSLVEKFLALQLELKNKMQSHIVKSEYILTPKIVAEINIELKNQGLIIDSLTKDNMIKLAKEVNKQALNSAIKVILSDNNTLSNETNKILGLAVGNNANNLAQTQSGMPNPPPLPLSGGIPNPPPLPLSGGIPNPPPLPLSGGIPNPPPLPLNGSMPPPPHLNSQGFISNSNNLDLNKLQAEYSHIHSLYTQFILNTTVQPKVLPQPTASSATSTERSEPETAYAKLYVEYRTETGGKKAYDLQDQLIKRQADLTNVIRQILTTSYANQGADEKTLVNVFSISTPEIEAKAKDVFNKLVQDPYIQYITVNGKKATTSEDIIKNLFNEDTDDAVKRILLSSCKISEELKKPIKHELNQLKLMREFESKTTLFEQLEFAYANAKNLDQDIFGNKVEELINNPKTLTTAQQATFLITEDTNLRKTIDTDQAQAKLDDLRKAILSTIKLEELIKANLPHNEFIAIVKEKEPELLKEFLKANTIKLEGNNNLDQLRLVLPSFTCMSDEQLRVLASKLNMTIILNALKEYSQVKAKKHINTGNMPPPPPPPPSGLKDAELAYLTTLGITKDWISRIARLNVKTSTSTFKTTPKIYNFSSDIAVRYKEFALSGQKSAGHKAKYSDADLFQKAIVESVAFEHSKNLSKVHQNNTYFAKIQEAIDTMHSSFIGPRTEIGQEIHNIYTSKLLALTKDKEFIKYVEDDIILSKKLTEAFTSADSDFIGPRTEIGQEVHNIYTQQLAKYPEETVKEAFNTANSDFIGPRTEIGQEVHNIYKSKLLELAKDKELFLCVEQLLAESAELEQKYGTDLQSENNNQEKKVGRLDPKQLRLFLQANESANDESSTKDNTQPEDSNKKSEEFDSETALSPRLLSSNDSKNDKSSDNIDLRSSDEEDKGYETDEELKESNNTTKEESQKDIALESEDEAIDVSFTTEAIAEQDEATQRQQVSDDTSRKVAILAKATSTLHKPVHYNILSDRLKVSAIGAGDEEPIIARGVWISGLYGMNKQGTWKNIPKYQGRTTGITIGADVEFINSHDVIGIAYSRLESKIKYNKKLGTIAVNGHLFSIYGLKELIKDLSLHAITSYGHNYVKNKSKNINNIIGKYQNNNLSFESLLNYKYHTKYDLHFIPNIGFKYDYSRASNYKEYNVDIENLMIQKKSNQLFESSIGGKIVFKPIATISNVVLTPSLYGNIERHFNHKNTKVNAKATFKGQILQETIIIPKQPKLGYNIGSNMLMSRKNINVLLEYNYYTHRKYQSHQGLVKLKVNL

SEQ ID NO: 22717 - protein, 1359 aa, Shigella flexneri
MNKIYSLKYSSLTGGLIAVSELSKKVKGKTGRKLMTASVALSVSLSALPVEASTVSAEIPYQTFRDFAENKGVFTPGATGIEIKDKNGNLTGVLNTPMLDFSSLSRDGHTTLIHPGYGVSAKHGRLQSLKTATFGYNAEYKIVNNNHASYDFTAPRYSKLVTEVIPVNTGDGKYNDSKKYTAFYRTGVGDQYIKDKKGNHTLLNRYAPQNAYLTGGTVGTPYYGRVSNQTVLISSPGNTFNQTHGPLASYGQSGDSGSPLYAWDNIQNKWVLAGVTLYNEGVNGSRNWWLELPNSFINETIKSDSKEIVVKNKKEDITWSFDKTQGTGVINLERKDHIINGHKNNNPDYGDNIVFSGEEGVINIKNDIAQGAGFIQFNNNYIVSTQNNSTWTGSGIIVNDGSEVYWGINGVKDDNLHKLGSGKLIINGNGINTGGLKVGDGTVLLSQHKDAEGRVQAFSSVNISSGRPVVVLSDDKQINPDNISWGYRGGTLDLNGNNITFTRIQASDYGAIITNNNDKKSITNLNISTLKDTDINVSVSDVHVLGGKGKPGDLFYDRGTGRYLILKKEKYSPFFQDVNNTSVWQYVGKNRNEAIAVVKSEKIKNSSKPYLFHGQLNGNMDINIQSGMGVNTFAIDGSVNIPNGTLSNKLGSLIFQGHPVIHAGVGVSAEQNDWETRYFTLNTLNLDGSDFHLSRNAVMTGNIHATNSSKVTLGSSSVYVDRNDGTGESVNSTSATASDINEKDLSKFTGDITADNSNIIINNKFEGGVSAVNKSAIDIHSQHAVINRWSDISDNSKLTLKKNATLTVNTGLVNKGTIEIGENAELNLQGYPIADKFIPSLHDLGNVKMTASNATLTAGNYAMFSGEITADDATAVRVNLGSETSTLSEFNPNPELTDLMFDKYNTSWTGKISALKGDASMVNTVWRMTGDSGLNTLKTSKSLTVFSSDNKFSTLTVNDLTTSDSTFVLRSDSTGSDKVVVKNKLEGKNNNLLVDYVANDGKHNSLNLELVSAPKGTAADVFNSQTQNVGFSDVTPVIEQKDSGEKTTWTLKGFNAVANQQSAEKAENFMSAGYKNFLAEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEVGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSVGLNAEIRDNVRFGLEFEKSAFGKYNVDNAVNANFRYSF

SEQ ID NO: 22718 - protein, 934 aa, Pasteurella haemolytica
MYKIKHSFNKTLIAISISSFLSIAYATESIENPQPIIQLSESLSSKYSGKGVKLGVMDEGFMVKHPRHSSHLHPLIHQLTTPEGEVRIYDASYPQFEVNPVEKEDGIDLIPSLETHGAGVAGIIAAQADKTLGDGYSGGIAKGAELYVATKSYKRTLEKVIQDAKKELENAKDEEDEKTPSLDQMAKNDLLASKEKEMAIERAEWASGLNKLLDNNVFAINNSWNPFSISDDINVVDKFYQSIKQNKHNPLLQAIMRAKNSNTLLVFAAGNESKKQPGVMALLPRYFPELEKNLISAVAVDKEQKIASYSNHCGASKNWCVAAPGDLHVLIGVADEHKKPQYGLTKEQGTSFSAPAITASLAVLKERFDYLTATQIRDTLLTTATDLGEKGVDNVYGWGLINLKKAVNGPTQFLNDETITVTRDDHWSNPLASQFKITKKGDKSLHLDGENHLDTVAVEEGRLALNGKTKVKTISNHANLAVNGTEVEQNYSSSGQSQLEVLGKSGLIANAQANIHLAGSLKIDDKLTEKTEAGDVSATVVQLKDKATYQGGFTQLVENENLAKRGLIQDLYFKESEIIAKVNKPLTDEKADTNGQAGLALLNALRTTPIAYRRSWYNGWLQSALEQRKLDNLHYAVSNNIYADSLELLRSQNAKGLTQAQQHLFTAYHTPLQTTVWAEHLNQKQSASSKHTDVKHHQSQLGVNHKLADKTVLSATLSQQKNRLEKPFAQATLKQTALNIGLRYHLDNAWFSEATLQFARQKYQQSRRFASHQLGTAETRGSTLGGEMRIGYQFMPNQWIIEPSLGVQWIQTKMNGLNESGELATQTAAMRYRDVNIVPSVKLQRTFQLEQGSISPYIGLNYLHRLNGKITKITSNIAGKTLHSEATTKRNRQLNGEVGVKLHYKNWFTAMNLDYSRVKSANLFGWKVNVGFSF

SEQ ID NO: 22719 - protein, 428 aa, Pseudomonas aeruginosa
ARDEVEHDRTGSCSSLRRDFAMAVASSQDESKGFVEDSKLNVKMRNLYFSRDYRNTESATNKAAGLRHDQREWGQGFIGTFESGFTQGTVGVGVDAIGMLGLKLDSGRGYSGSGLFPTGSDQRSQDDYSKGGAAAKFRISDTVLKVGDQFTALPVFATDDSRLLPEIAQGALVTSNEIKGLTLHAGRFTSLTAQAETNRDSFRLKKADVIGGTYALTDSLSTSLYYSKVEDYWRKYYANVNWALPISDKQGLVFDFNIYDTKSDGADLYKAAADGDKLDNRAYSFSGAYNIGAHTFTLAYQKVTGDGEYAYGVDGGGTIFLANSVARSDFNAEGEKSWQVRYDLNFAEFGVPGLTFMTRYVRGTGAHTADTNDGKEWERDVDVKYVLQEGPAKDLSFRVRQATYRSSGQFGFDRRTASDRRIPAEHLV

SEQ ID NO: 22720 - protein, 914 aa, Neisseria meningitidis serogroup B
MQQQHLFRLNILCLSLMTALPAYAENVQAGQAQEKQLDTIQVKAKKQKTRRDNEVTGLGKLVKSSDTLSKEQVLNIRDLTRYDPGIAVVEQGRGASSGYSIRGMDKNRVSLTVDGVSQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIHTGRRAGEIRAHEDAGRGVQSFNRLVPVEDTNQYAHFVVEEECPNGYAACKDKPKKDVVGKDERQTVSTRDYTGPNRFLADPLSYESRSWLFRPGFRFENKRHYIGGILEHTQQTFDTRDMTVPAFLTKAVFDANSKQAGSLPGNGKYVGNHKYGGLFTNGENGALVGAEYGTGVFYDETHTKSRYGLEYVYTNADKDTWADYARLSYDRQGIGLDNHFQQTHCSADGSDKYCRPSADKPFSYYKSDRVIYGESHRLLQAAFKKSFDTAKIRHNLSVNLGFDRFGSNLSHQDYYYQNANRAYSSKTPPKNGNKNISPNGSKEKPYWVSIGGGNVVTEQICRLGNNTYTDCTPRSINGKSYYAAVRDNVRLGRWADVGAGLRYDYRSTHSDDGSVSTGTHRTLSWNAGIVLKPADWLDLTYRTSTGFRLPSFAEMYGWRAGVQSKAVKIDPEKSFNKEAGIVFKGDFGNLEASWFNNAYRDLIVRGYEAQIKNGKEEAKGDPAYLNAQSARITGINILGKIDWNGVWDKLPEGWYSTFAYNRVHVRDIKKRADRTDIQSHLFDAIQPSRYVVGLGYDQPEGKWGVNGMLTYSKAKEITELLGSRALLNGNSRNTKATARRTRPWYIVDVSGYYTIKKHFTLRAGVYNLLNYRYVTWENVRQTAGGAVNQHKNVGVYNRYAAPGRNYTFSLEMKF

SEQ ID NO: 22721 - protein, 911 aa, Neisseria gonorrhoeae
MQQQHLFRLNILCLSLMTALPAYAENVQAGQAQEKQLDTIQVKAKKQKTRRDNEVTGLGKLVKTADTLSKEQVLDIRDLTRYDPGIAVVEQGRGASSGYSIRGMDKNRVSLTVDGLAQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIHTGRRAGEIRAHEDAGRGVQSFNRLVPVEDSSEYAYFIVEDECEGKNYETCKSKPKKDVVGKDERQTVSTRDYTGPNRFLADPLSYESRSWLFRPGFRFENKRHYIGGILEHTQQTFDTRDMTVPAFLTKAVFDANSKQAGSLPGNGKYAGNHKYGGLFTNGENGALVGAEYGTGVFYDETHTKSRYGLEYVYTNADKDTWADYARLSYDRQGIGLDNHFQQTHCSADGSDKYCRPSADKPFSYYKSDRVIYGESHRLLQAAFKKSFDTAKIRHNLSVNLGFDRFDSNLRHQDYYYQHANRAYSSKTPPKTANPNGDKSKPYWVSIGGGNVVTGQICLFGNNTYTDCTPRSINGKSYYAAVRDNVRLGRWADVGAGLRYDYRSTHSDDGSVSTGTHRTLSWNAGIVLKPADWLDLTYRTSTGFRLPSFAEMYGWRSGVQSKAVKIDPEKSFNKEAGIVFKGDFGNLEASWFNNAYRDLIVRGYEAQIKNGKEEAKGDPAYLNAQSARITGINILGKIDWNGVWDKLPEGWYSTFAYNRVHVRDIKKRADRTDIQSHLFDAIQPSRYVVGLGYDQPEGKWGVNGMLTYSKAKEITELLGSRALLNGNSRNTKATARRTRPWYIVDVSGYYTIKKHFTLRAGVYNLLNYRYVTWENVRQTAGGAVNQHKNVGVYNRYAAPGRNYTFSLEMKF

SEQ ID NO: 22722 - protein, 602 aa, Neisseria meningitidis serogroup B
MQQQASYFAAVAVMMGLPVAASALETPPIVVTAERLPTSVDETLAPVTVITRADIEATNPQSIDDLLRLQPGVDVARSGGLGGNTSVFLRGTNSNHVLVLIDGVRASSPASGLFAWRQMSPAQIERIEIVRGPRATLYGSDAVGGVIQIFTRQPEGVTASVTAGSQDTQRAEAGFGFGAATRLTLNTSFVRTDGISATNPGNPSYDPDDDGFINRSLNARFTAPLWGNAALRLSGWYANGDVEFDQGVQGIVNGNFSARLTDSPARVWGYALTLGFNQDDIETKSAFPSKISTQRTTLDWQNNLHLSKTQSLTLGLTWRRNIGKNSDPATSVVVFNDFTTNTGVYANWLGAFGNSDLEAGVRYNHQSEFGGYVTGQFAWGYSLGAGYRVILSYGTAFKAPDLNELFHPGFGGFFAGNPDLEPERSRSAELAVRYHQPGGRRRLEANLFYTRIDDLIAFEGEMSQAINIDEAKIPGLELQYTDGIGRWSLHSSLTLQRPRNISTHARLLRRPDSKFSLVLARALGNGGLIRGELLRVGQRADVGDETLGGYTLFNLSGQIRLAQAWSVEGRIENVTDKQYENAFGFNTLGRVFYLSLRYAADD

SEQ ID NO: 22723 - protein, 912 aa, Haemophilus influenzae
MTKKPYFRLSIISCLLISCYVKAETQSIKDTKEAISSEVDTQSTEDSELETISVTAEKVRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGLAIYTQRNSIETQVHKDALKGVQSYNRLIAKEDGSNAYFVMEDECPKDYNSCIPSAKPPAKLSSQRETVSVSDYTGANRIKPNPMKYESQSWFLRGGYHFSEQHYIGGIFEFTQQKFDIRDMTFPAYLRSTEKPDLENSSFYPKQDYGAYQRIEDGRGVKYASGLYFDEHHRKQRVGIEYIYENKNKAGIIDKAVLSANQQNIILDSYMQHTHCSLYPNPSKNCRPTLDKPYSYYHSDRNVYKEKHNMLQLNLEKKIQQNWLTHQIVFNLGFDDFTSALQHKDYLTRRVTATAKSISEKPGETPRRNGFKLQPYLYPKPNASFVGRDHCNYQGSSSNYSDCKVRLIKGKNYYFAARNNMALGKYVDLGLGIRYDVSRTKANESTISVGKFKNFSWNTGIVIKPTEWLDLSYRLSTGFRNPSFAEMYGWRYGGKNDEVYVGKFKPETSRNQEFGLALKGDFGNIEISHFSNAYRNLIAFAEELKNGKGKGNYGYHNAQNAKLVGVNITAQLDFNGLWKRIPYGWYATFAYNRVKVKDQKINAGLASVSSYLFDAIQPSRYIIGLGYDHPSNTWGINTMFTQSKAKSQNELLGQRSLGNTSRGVKSTRKLTRAWHILDVSGYYMVNRSILFRLGVYNLLNYRYVTWEAVRQTAQGAVNQHQNVGNYTRYAASGRNYTLTLEMKF

SEQ ID NO: 22724 - protein, 355 aa, Haemophilus ducreyi
MKMKFIPAALLAAAAGVVQADETSGFNLKAGSGITFKSADGTASFRVGGRLQWDYDSTDSDISGKSDDFDVRRARIFFQGKYLDWAFKAQFNLAESGTGGGSAEDLYLRYTGFGKMARITVGKQKEPFGFEQLTSSKDISSLERSALTEFYAPGRNAGVQLHGAGDNWTYGLGVFEAAGNGSDDFGNTAITGRVTYAPIQTDDLVLHLGAGFTSRDAALPANETDAYNIELAAASGPFHTQAEYFNADTGGVDVDGYYIQAGWILTGESRPYSNGVFKRVKPSSSKGAWEAVLRYEDGYGKFSDVGLGTTEGKQTTVGINYYPNNAVRLGLSYMDGKQASGENGKEIRARMQIVF

SEQ ID NO: 22725 - protein, 394 aa, Haemophilus influenzae
MNILINKRIFLLVTLVGIQLNVTAKQNSSNSNREELLPIIVNTDEDSNKLPGRSVLKQKNIEQQQADNVANLINILPGVNMAGGFRPGGQTLNINGMGDAEDVRVQLDGATKSFEKYQQGSIFIEPELLRKVTVDKGNYSPQYGNGGFAGTVKFETKDAKDFLQENQKIGGLLKYGNNSNNNQKTYSTALVLQNEQKNIDLLLFGSIRNADDYKRPDNSKILFSKNNQKTGLIKVNWQISPEHLLTLSSVYGIHKGWEPFAAKRDILPKPSSHDIKRYGTDIAWKRKLVYRDQKDENYTLKYNYLPENNPWINLSTQFSYSKTTQNDTRHEKASSVFSATLGNQSWITYSDLTFDINNTSTFNIKSTRHELLFGLQWLKKHKKYFNVSQGEDDR

SEQ ID NO: 22726 - protein, 745 aa, Haemophilus influenzae
MNILINKRIFLLVTLVGIQLNVTAKQNSSNSNREELLPIIVNTNDDSNKLPGRSVLKQKNIEQQQADNAANLINILPGVNMAGGFRPGGQTLNINGMGDAEDVRVQLDGATKSFEKYQQGSIFIEPELLRRVTVDKGNYSPQYGNGGFAGTVKFETKAARDFLQENQKIGGFLKYGNNSNNNQKTYSTALVLQNEQKNIDLLLFGSVRNAGDYKRPDNSKILFSKNNQKTGLIKVNWQISPEHLLTLSSVYGIHKGWEPFAAKRDILPKPSSGDIMRYGADIAWKRKLVYRDQKDKNYTLKYNYLPENNPWINLSTQFSYSKTTQNDTRPEKAPPVFLGTLGNQSWITYSDLTFDINNTSTFNIKSTRHELLFGLQWLKNTRNTLMYDKSKVKKEDYNYGYFQPYYMPSGRQYTQALYLQDQITWKNIIFSTGVRYDHINNIGQKNFAPQYNDISVGQNYSQKNYNGWSYYLGLKYDVNHYLSLFTNFSRTWRAPVIDEQYETQYKQSSGPVTATSLNLEKEMINQTRVGGIITLNHLFQENDVFQFRTTYFYNRGKNEIFKTRGVNCVGNAADTNHVCPKIIGNYRNLPGYVIQGAELEAYYQSTYLFGEITYSYVKGKRDTSPRNPWGKTSTWIAEIPPRKATTALGFNIPKYNFTAGWRAEFVRRQDRSPLSGDPEAKYWSLPASRGYSLHNLFLSWSPAKIKGMNIKITVDNLFNRAYNPYLGELASGTGRNIKFSLSQKF

SEQ ID NO: 22727 - protein, 1025 aa, Escherichia coli
MNKVYNHLLAVADQPKSLGEIAGILTKKYQKLLGLVLVFCLLNIQAYAQTKVSGKVLDAKGEGLPGATIIEKGTTNGTSSLSDGSFSINVKPDATLIFSFVGYATQEIVVGAQTVINVTLTDDAALQEVVVVGYGTQKKSDVTGVVTKIDSKNFNKGPIVSPDQLINGKIAGVQVQSNSGEPGGQTRIRIRGGTSINASNEPLYVIDGVPIDNTAVNPGGFQDGRNPLNFLNPDDIESFTVLKDASATAIYGSRGNNGVIIITTKKGRSGKGKLNYSNWFSVGSIANKIDVFNAAEFRTVVQDKASGRVNELGNTSTNWQDQLYQTAIGQNHSLSYAGGIKGLNYRTSLGYLKQDGTLKGTSAERISFALGLNAKLFKQLNVDANIKLAQNKDTFSPNSIIGGALRMDPTQAIFDANDTQYGGYFEYANDLATKNPVAELALTDDQGKNLRTLGNIKFDYQMPFLKGLSANLNLGYDHLKGDRQRTLPTNLRSQSGTLGEHRTADYTKTNSLLEFYLKYTKDFKEINSRLDITGGYSYQDFREEYIDSVFTDLTGATPKNKQGFKNIQKNRLISFYGRVNFSYADKLLLTATLRRDGSSRFGLNNRWGSFPSVAAAYRLSEEAFLKNSKVISDLKIRAGYGITGNQDIAGQNFAYLPTYTLGDSTAAYQFGNTFVNTIRPNAYDQNLKWEEVKSFNIGLDFGLFAGRLSGSVEYYKKTTKDLLFTVPVAAGANLSDRVLTNVGELENSGVEFALDAVAINSKAFQWNVGFNIAWNRNTLLRFSKINDPAFVGILTGGILGGTGNTVQILQMNQAANSFYLFKHKMGTDGKPLVDGIDHNGDGNIDNADIYEDINGPDGKPDGRVDELDKRAVENPAPNILMGLTSNMRFKGFDLSFTFRANLGNYVYNNVKSNGAYYNRVINEIVPTNMPRSVTETNFVAPQYFSDVYLEDASFLRLDNITLGYTFDQLLKNKFNLRAYVTAQNLFVITNYSGLDPEVANKDALGIDNDIFPRARTIIMGLSLGF

SEQ ID NO: 22728 - protein, 1033 aa, Orientia tsutsugamushi
MKKIMKHKFQYMLLLLLAIPCHSFAGEKSHVADSENLLLNKSLQQSVTIKGNVTDAAGEPLIGVSVLVKGTTNGTITDFDGNFSLSAQKGDILEISYIGYATQSVTITNNQPLKIVLKEDTKVLDEVVVTALGIKREQKALSYNVQQVKNDAFNTVKEANFMSALVGKVAGVTINSSSTGAGGAARVIMRGSKSITKDNNALYVIDGIPMFNANAGGASDSRYSTQAGSDGVADLNPDDIESINMLTGPSAAALYGNAAANGVVLINTKKGNVERTSLTVTNNTTFSDVYMMPEMQNRYGNMEGAFESWGGTTTKRYDPKKFFNTGSNVINTISFSTGTKKNQTYASASTTHSTGIIPNNSYSRYNFSIRNTANFLNDKLTLDLSANYIIQNDKNMTSQGEYFNPIPALYLFPRNDNFDEIQLYERYSVGRDLMVQYWPYDAQGMSLQNPYWIANRMNRTTKKNRYMISGGLTYKIADWVNVVGRVKVDNSDYRMQQKRYASTLGTFAGANGFYSDMTRTDRNIYADVMVNIDKRIKDFSINANIGASIKDLVYEQMGGEGDLAGIPNFFTVRNLNYSSNFKPKQFGYHDQSQSIFANLEVGWKSQVYLTLTGRNDWESMLAYTDTPSFFYPSVGLSVVLSEMFKLPEFMSYAKVRGSYSKVASSFERYLSNPGFAFNEQSHQWATSTTRPAKNLKPEDTRSWEIGLNLKFWRDLSLDFTYYHSNTYNQTFSVDEPSSSGFSKSYVQTGNIENHGIEMALGYGHQWGDFTWNSTYTFTLNRSKVISLADGEINQNTGEVIEMPELRVATLGADGYGPRVILRKGGSMSDLYVEKELKRDGNGSIWVDSQSGKLAVTTYDSPKKIGDMAPKANMGWYNSFSYKGFNLGMMLTARLGGLVVSNTQGVLDYYGVSKASADARDAGGVWINNGYVDAKEYYQTIGGSNGGLGQYYTYSATNVRLSELSFSYAFPKKWFNNKVGITAGFVAKNLWMIYCKAPFDPELTASTSSNFYQGVDYFMTPSTRNLGFNVKFQF

SEQ ID NO: 22729 - protein, 1377 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 22730 - protein, 294 aa, Enterobacter aerogenes
MKKTLLAAGAVVALSTTFAAGAAENDKPQYLSDWWHQSVNVVGSYHTRFGPQIRNDTYLEYEAFAKKDWFDFYGYIDAPVFFGGNSTAKGIWNKGSPLFMEIEPRFSIDKLTNTDLSFGPFKEWYFANNYIYDMGRNDSQEQSTWYMGLGTDIDTGLPMSLSLNVYAKYQWQNYGASNENEWDGYRFKVKYFVPLTDLWGGSLSYIGFTNFDWGSDLGDDNFYDLNGKHARTSNSIASSHILALNYAHWHYSIVARYFHNGGQWADDAKLNFGDGPFSVRSTGWGGYFVVGYNF

SEQ ID NO: 22731 - protein, 1295 aa, Helicobacter pylori
MEIQQTHRKINRPLVSLALVGALVSITPQQSHAAFFTTVIIPAIVGGIATGTAVGTVSGLLSWGLKQAEEANKTPDKPDKVWRIQAGKGFNEFPNKEYDLYRSLLSSKIDGGWDWGNAARHYWVKGGQQNKLEVDMKDAVGTYKLSGLRNFTGGDLDVNMQKATLRLGQFNGNSFTSYKDSADRTTRVNFNAKNISIDNFVEINNRVGSGAGRKASSTVLTLQASEGITSSKNAEISLYDGATLNLASNSVKLNGNVWMGRLQYVGAYLAPSYSTINTSKVTGEVDFNHLTVGDKNAAQAGIIASNKTHIGTLDLWQSAGLNIIAPPEGGYKDKPNNTPSQSGTKNDKNESAKNDKQESAQNNSNTQVINPPNSAQKTEIQPTQVIDGPFAGGKDTVVNINRINTKADGTIRVGGYKASLTTNAAHLHIGKGGVNLSNQASGRSLLVENLTGNITVDGPLRVNNQVGGYALAGSSANFEFKAGTDTKNGTATFNNDISLGRFVNLKVDAHTANFKGIDTGNGGFNTLDFSGVTGKVNINKLITASTNVAVKNFNINELIVKTNGVSVGEYTHFSEDIGSQSRINTVRLETGTRSIFSGGVKFKSGEKLVIDEFYYSPWNYFDARNIKNVEITRKFASSTPEKPLGTSKLMFNNLTLGQNAVMDYSQFSNLTIQGDFINNQGTINYLVRGGKVATLNVGNAAAMMFNNDIDSATGFYKPLIKINSAQDLIKNTEHVLLKAKIIGYGNVSTGTNGISNVNLEEQFKERLALYNNNNRMDTCVVRNTDDIKACGMAIGNQSMVNNPDNYKYLIGKAWRNIGISKTANGSKISVYYLGNSTPTENGGNTTNLPTNTTNNARSANYALVKNAPFTHSATPNLVAINQHDFGTIESVFELANRSKDIDTLYTHSGAQGRDLLQTLLIDSHDAGYARQMIDNTSTGEITKQLNAATDALNNVASLEHKTSGLQTLSLSNAMILNSRLVNLSRRHTNHINSFAQRLQALKGQRFASLESAAEVLYQFAPKYEKPTNVWANAIGGASLNNGSNASLYGTSAGVDAYLNGNVEAIVGGFGSYGYSSFSNQANSLNSGANNTNFGVYSRIFANQHEFDFEAQGALGSDQSSLNFKSALLQDLNQSYNYLAYSAATRASYGYDFAFFRNALVLKPSVGVSYNHLGSTNFKSNSTNQVALKNGSSSQHLFNASANVEARYYYGDTSYFYMNAGVLQEFANFGSSNAVSLNTFKVNAARNPLNTHARVMMGGELQLAKEVFLNLGVVYLHNLISNIGHFASNLGMRYSF

SEQ ID NO: 22732 - protein, 1303 aa, Helicobacter pylori
MEIQQTHRKINRPLVSLALVGALVSITPQQSHAAFFTTVIIPAIVGGIATGAAVGTVSGLLSWGLKQAEQANKTPDKPDKVWRIQAGRGFNNFPNKQYDLYKSLLSSKIDGGWDWGNAARHYWVKDGQWNKLEVDMQDAVGTYNLSGLINFTGGDLDVNMQKATLRLGQFNGNSFTSFKDGANRTTRVDFNAKNILIDNFVEINNRVGSGAGRKASSTVLTLQASEKITSRENAEISLYDGATLNLVSSSNHSVDLYGKVWMGRLQYVGAYLAPSYSTIDTSKVEGEMNFRHLAVGDQNAAQAGIIANKKTNIGVLDLWQSAGLNIIAPPEGGYESKNKDNPQNNPKNDTQKTETEPTQVIDGPFAGAKDTVVNIFRLNTNADGTIRVGGFKASLTTNVAHLHIGEGGVNLSNQASGRTLLVENLTGNITVEGALRVNNQVGGSAVAGSSANFEFKAGADTNNGTATFNNDIHLGKAVNLRVDAHTAYFNGNIYLGKSTNLRVNGHSAHFKNIDATKSDNGLNTSALDFSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFTERLALYNNNNRMDICVVRKNNTDDIKACGMAIGNQSMVNNPENYKYLEGKAWKNTGINKTANNTTIAVNLGNNSAPTENGGNTTNLPTNTTNKARFASYALIKNAPFARYSATPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNHIDSFAQRLQALKGQRFASLESAAEVLYQFAPKYEKPTNVWANAIGGTSLNNGSNASLYGTSAGVDAYLNGEVQAIVGGFGSYGYSSFSNQANSLNSGANNTNFGVYSRLFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANMEARYYYGDTSYFYMNAGVLQEFARFGSNNAASLNTFKVNATRNPLNTHARVMMGGELQLAKEVFLNLGVVYLHNLISNASHFASNLGMRYSF

SEQ ID NO: 22733 - protein, 936 aa, Helicobacter pylori
MEIQLSTLFSTYLLTSLFACLPLSLHASEKEAPYSWKTFGYEQLLKPEFFFDILEEQNTLEGLTRSTGGITVENYKNIICSQQISITPGGVFDAASVTIQNIQNDIKFISNITTQKGGVIHTPGNCTITQNLGKQYYISNESNASASTANSSYYGGVVYCRGDFELSKNRATICFAYNVARQRGGAIASETYCKIRENTHPILFTNNLALKEQGGAIYCRDCEIANNSGPICITSNCSPIGGGCLATSSVAIKNNSNLILFSNNSGVCDQPVGATSSGGAISAPMINIENNSGPICFDNNIVDRNGGALWFSTLTIKNNGLVQFINNRSKWGGALLIKNNGSCELSADNGDIIFDSNCGIKSDQLYRNAMHCTAGTTLKIGAKKNRCVKFYDPIQCTYSSPLIAFNHEDYHQGTILFSSVFVPPSFKLNDNFMSYIRNPLTIHNGVLAIEDRAALAAYQITQTEGTLRLGNGAVITTIQNASPQTTDGCTLALSKLALNLPSILAKGAEAPKIWVYPAGSNNNYTEDPNPTITISGPLKLLDNYNDDPYDSLNLSHGITRVPFLYLCDNATKKINIDALNVEAINDHLHYGYQGVWSPYWEEYTTITNPTSVLTANTSHRLLYADWTPTGYIPNPKYKTPLIANALWGSVYTTLSGMRTLPSPVANPDHFELSSQGVLLGVRQHNRSGIRGFRMESSGYALTSSAATKIDRKISFAFSQQMSHIKEHTTSNKVSSKNFFGSVQLRLPWLTASLAYNYGDHTAKHFYTEDNKDSEGNFHSHTFGACLNFTLNRSPINNAFIAPFIEAVAFRAMLSGFTEQGDFARKFTMHKHLQNLALPVGMIVQWAYDGHLPTTWQIQLAYHPVIYRHYPKVATTLLASSGTWHSSGTPIARNAFSFKIGNETQILSYVNIFLNYQGEGSSSFFSHYLKAGSTLTF

SEQ ID NO: 22734 - protein, 1296 aa, Helicobacter pylori
MEIQQTHRKINRPLVSLALVGALVSITPQQSHAAFFTTVIIPAIVGGIASGAAVGTVSGLLGWGLKQAEEANKTPDKPDKVWRIQAGKGFNEFPNKEYDLYRSLLSSKIDGGWDWGNAATHYWVKGGQWNKLEVDMKDAVGTYNLSGLRNFTGGDLDVNMQKATLRLGQFNGNSFTSYKDSADRTTRVDFNAKNISIDNFLEINNRVGSGAGRKASSTVLTLQASEGITSSKNAEISLYDGATLNLASSSVKLMGNVWMGRLQYVGAYLAPSYSTINTSKVTGEVNFNHLTVGDRNAAQAGIIASNKTHIGTLDLWQSAGLNIIAPPEGGYKDKPNNTPSQSGAKNDKNESAKNDKQESSQNNSNTQVINPPNSAQKTEVQPTQVIDGPFAGGKDTVVNINRINTNADGTIRVGGYKASLTTNAAHLHIGKGGVNLSNQASGRTLLVENLTGNITVDGPLRVNNQVGGYALAGSSANFEFKAGTDTKNGTATFNNDISLGRFVNLKVDAHTANFKGIDTGNGGFNTLDFSGVTDKVNINKLITASTNVAIKNFNINELLVKTNGVSVGEYTHFSEDIGSQSRINTVRLETGTRSIFSGGVKFKGGEKLVINDFYYAPWNYFDARNIKNVEITNKLAFGPQGSPWGTSKLMFNNLTLGQNAVMDYSQFSNLTIQGDFVNNQGTINYLVRGGQVATLNVGNAAAMFFNNNVDSATGFYQPLMKINSAQDLIKNKEHVLLKAKIIGYGNVSAGTNSISNVNLIEQFKERLALYEHNNRMDICVVRNTDDIKACGTAIGNQSMVNNPDNYKYLIGKAWKNIGISKTANGSKISVHYLGNSTPTENSGNTTNLPTNTTSNARSAKNALAQNAPFAQPSATPSLVAINQHDFGTIESVFELANRSKDIDTLYTHSGAQGRNLLQTLLIDSHDAGYARQMIDNTSTGEIIKQLNAATTTLNNVASLEHKQSGLQTLSLSNAMILNSRLVNLSRRHTNNIDSFAQRLQALKDQKFASLESAAEVLYQFAPKYEKPTNVWANAIGGTSLNNGGNASLYGTSAGVDAYLNGEVEAIVGGFGSYGYSSFSNQANSLNSGANNTNFGVYSRLFANQHEFDFEAQGALGSDQSSLNFKSALLRDLNQSYNYLAYSAATRASYGYDFAFFRNALVLKPSVGVSYNHLGSTNFKSNSTNQVALKNGSSSQHLFNASANVEARYYYGDTSYFYMNAGVLQEFANFGSSNAVSLNTFKVNAARNPLNTHARVMMGGELKLAKEVFLNLGFVYLHNLISNIGHFASNLGMRYSF

SEQ ID NO: 22735 - protein, 1303 aa, Helicobacter pylori J99
MEIQQTHRKINRPLVSLALVGLLVSITPQQSHAAFFTTVIIPAIVGGIATGAAVGTVSGLLSWGLKQAEEANKTPDKPDKVWRIQAGRGFNNFPNKQYDLYKSLLSSKIDGGWDWGNAARHYWVKDGQWNKLEVDMQDAVGTYNLSGLINFTGGDLDVNMQKATLRLGQFNGNSFTSFKDAANRTTRVNFDAKNILIDNFLEINNRVGSGAGRKASSTVLTLKSSEKITSRENAEISLYDGATLNLVSSSNHSVDLYGKVWMGRLQYVGAYLAPSYSTINTSKVVGEMNFRHLAVGDQNAAQAGIIANKKTNIGVLDLWQSAGLSIITPPEGGYESKTKDNPQNNPKNDTQKTEIQPTQVVDGPFAGGKDTVVNIFRLNTKSDGTLKAGGFKASLSTNAAHLNIGEGGVNLSNQASGRSLLVENLTGNITVEGALRVNNQVGGSAVAGSSANFEFKAGEDTNNTTATFNNDIHLGKAVNLRVDAHTAYFNGNIYLGKSTNLRVNGHSAHFKNIDASKSDNGLNTSTLDLSGVTDKVNINKLTTSATNVSIKNFDIKELVVTTRVQSFGQYTIFGENIGDQSRIGVVSLQTGYSPAYSGGVTFKGGKKLVIDELYHAPWNYFDARNITDVEINKKILFGAPGNIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNKARFASYALIKNAPFARYSATPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNHIDSFAQRLQALKGQRFASLESAAEVLYQFAPKYEKPTNVWANAIGGTSLNNGSNASLYGTSAGVDAYLNGEVQAIVGGFGSYGYSSFSNQANSLNSGANNTNFGVYSRLFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANMEARYYYGDTSYFYMNAGVLQEFARFGSNNAASLNTFKVNATRNPLNTHARVMMGGELQLAKEVFLNLGVVYLHNLISNASHFASNLGMRYSF

SEQ ID NO: 22736 - protein, 1291 aa, Helicobacter pylori
MEIQQTHRKINRPLVSLALVGALVSITPQQSHAAFFTTVIIPAIVGGIATGAAVGTVSGLLGWGLKQAEEANKTPDKPDKVWRIQAGKGFNEFPNKEYDLYKSLLSSKIDGGWDWGNAARHYWVKDGQWNKLEVDMQNAVGTYNLSGLINFTGGDLDVNMQKATLRLGQFNGNSFTSYKDSADRTTRVDFNAKNILIDNFLEINNRVGSGAGRKASSTVLTLQASEGITSRENAEISLYDGATLNLASNSVKLMGNVWMGRLQYVGAYLAPSYSTINTSKVTGEVNFNHLTVGDHNAAQAGIIASNKTHIGTLDLWQSAGLNIIAPPEGGYKDKPNDKPSNTTQNNAKNDKQESSQNNSNTQVINPPNSAQKTEIQPTQVIDGPFAGGKNTVVNINRINTNADGTIRVGGFKASLTTNAAHLHIGKGGINLSNQASGRSLLVENLTGNITVDGPLRVNNQVGGYALAGSSANFEFKAGTDTKNGTATFNNDISLGRFVNLKVDAHTANFKGIDTGNGGFNTLDFSGVTNKVNINKLITASTNVAVKNFNINELVVKTNGVSVGEYTHFSEDIGSQSRINTVRLETGTRSIYSGGVKFKGGEKLVINDFYYAPWNYFDARNIKNVEITNKLAFGPQGSPWGTAKLMFNNLTLGQNAVMDYSQFSNLTIQGDFVNNQGTINYLVRGGQVATLNVGNAAAMFFSNNVDSATGFYQPLMKINSAQDLIKNKEHVLLKAKIIGYGNVSAGTDSIANVNLIEQFKERLALYNNNNRMDICVVRNTDDIKACGTAIGNQSMVNNPENYKYLEGKAWKNIGISKTANGSKISVHYLGNSTPTENGGNTTNLPTNTTNKVRFASYALIKNAPFARYSATPNLVAINQHDFGTIESVFELANRSNDIDTLYANSGAQGRDLLQTLLIDSHDAGYARTMIDATSANEITKQLNTATTTLNNIASLEHKTSGLQTLSLSNAMILNSRLVNLSRRHTNHIDSFAKRLQALKDQRFASLESAAEVLYQFAPKYEKPTNVWANAIGGTSLNSGGNASLYGTSAGVDAYLNGEVEAIVGGFGSYGYSSFSNQANSLNSGANNTNFGVYSRIFANQHEFDFEAQGALGSDQSSLNFKSALLRDLNQSYNYLAYSAATRASYGYDFAFFRNALVLKPSVGVSYNHLGSTNFKSNSNQKVALKNGASSQHLFNASANVEARYYYGDTSYFYMNAGVLQEFANFGSSNAVSLNTFKVNATRNPLNTHARVMMGGELKLAKEVFLNLGFVYLHNLISNIGHFASNLGMRYSF

SEQ ID NO: 22737 - protein, 611 aa, Enterobacteria phage lambda
MRNTSWIAATLKSGVALSALLSSTLASTAQEADLDEVIVVANRTETEAGKVGSTTHVVTEEDLKNDGATFVSEYLTKLPGISFSQNGGAGTNSTLRIRGMNNYYTKVLVDGIDISDPSSPQVEARLEHMLLNDVERIEILKGSQSALYGGQAIAGVVNIITKRAAPGTVKHNATVEGGSYGTVNASYGLKAATETADIAINLQRFHTDGFSAVSPKGRPSDEDGYENKTFSAKGSVDLSEELNVYFAARGLHGTTEYDGSDAPAANNKVDAKQYFGKVGANYIWLDDRMTTDVSIQFSDLTREYNSGYTAKGNRVKIEFLNDFDVSDSLRLNYGGDWSREKVKGQSKKIEVAGSFVQALWNPTDPLNISGAVRLDHHSAYGYYLTGRGTVSYQVLENTRIRSSLGNGFRAPSSYELYDSYSGNPDFEPETSVSYDIGIDQNFLDEKLRLSLGYFHILTEDLIINNPADYKYEQINGLSRSQGAELSADWDVLDNLSFNSAYTYTWAVGPDKKRLRRVPLHDINLGFTYKPWEPLSLSVNANYVYGLKDLDTSKKPITLDDFVLVNAKAAYQYNDNLTFHVRGENLLDQDYERIKDYQTPGLSVYAGVSASF

SEQ ID NO: 22738 - protein, 695 aa, Rickettsia typhi
MLKKKNIILFSLFVSSLLFANETTKLEEITVSANKMEENIQDVPQSITVIDEETIEQKGIKNISDVIKEVPNMNIMANTGMGTTTSFRGLNASMFTNNNPVVIYIDGVPYYDRFDFNPSLANVEQIEILRGPQGTLYGKDAIGAVINITTKSPSNEWHGNIGAEYGNDNTFNTKLNTSGAIINNKLFAGINGSYNHSDGWITNHYPGMKEDANEKNDRKTSGFLLYKPTDELSAKLTLADNYTKNYFMDGFSSDPSLDINSLKRKDAENANYDVPAWDKQKVKSQALNLSYELEKVKIDSTSTHKKFDLNAEFDSDNRADNANDGLRQWNYTKVDTYSQELKLSSKNQDIKWVTGLYFDKENRKQGPYGAEQLYLGAVYVGDAYSDSDSKTQAIFGQTMIPLGEDFELTLGGRYQKINKEIDVVAKSSWAGMSIPDVSYEDEKTWNTFLPKAALSYKINDNLTTYVSVSKGYMPGGFNYYPSTSNGQDNTFEPQKSTNYEIGAKYIGDSFALNTSIFRMDIEDIHVYKQLMGGTVFATSNAKKAHSQGIEVDGTYFLTDNLSLFGAVGLIQAKYDDYDNGTRKYDGEKIENTPSYTANFGISYLANSGLYGRLDFNARGNTSYLDGGNNDRLIRADGGITANTKIGYRIKNWDIYSYVNNITDEDYVTSYMSKSGSSWVGFNDPRRFGIGAIYKF

SEQ ID NO: 22739 - protein, 359 aa, Rickettsia felis
MLRITMGIKGTGIIVWVDDATAKTKNATLTWTKTGYKPNPERQGPLGPNSLWGSFVDVRSIQSLMDRSTSSLSSSTNLWVSGIADFLHEDQKGNQRSYRHSSAGYALGGGFFTASENFFNFAFCQLFGYDKDHLVAKNHTHVYAGAMSYRHLGESKTLAKILSGNSDSLPFVFNARFAYGHTDNNMTTKYTGYSPVKGSWGNDAFGIECGGAIPVVASGRRSWVDTHTPFLNLEMIYAHQNDFKENGTEGRSFQSEDLFNLAVPVGIKFEKFSDKSTYDLSIAYVPDVIRNDPGCTTTLMVSGDSWSTCGTSLSRQALLVRAGNHHAFASNFEVFSQFEVELRGSSRSYAIDLGGRFGF

SEQ ID NO: 22740 - protein, 243 aa, Rickettsia prowazekii
MLRIVKKLGITLLVSSISMSSFAKSMYNDIDSTEYYDSTPYYENEGSLVFKVRLGATFSSAKQKGLPPPTSTQPVSVGEVAKNGYGGNASTTIFFNNYLATELSLGFNVLRTKYKAIANVAHNYGAVTKLGKYKPIYMIPATITGQFHIAPYGGIRPYIGLGYHGSYMLTQATSLKIRNGHGAVGQIGVDFYAKDDTLINLDVKQFLLNPKLEYKPNLVGNKTVTSKVKLNPLIVSIGIGFPF

SEQ ID NO: 22741 - protein, 466 aa, Neisseria meningitidis serogroup B
MTPSALKKTVLLLGTAFAAASVHASGYHFGTQSVNAQSTANAAAAEAADASTIFYNPAGLSKIDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 22742 - protein, 244 aa, Rickettsia conorii
MLRIVKKLGIILFVSTISINSFAKSMYDDVDSASDYDSTPYYENEGSLVFKIRLGGVVSSAKQKGLPTPTSPQPVSVGELAKNGYGGDASTTIFFNNYLATELSLGFNVLRTKYTSLAAVAHNYGVDNVKLGKNKPIYMIPATVTGQFHIAPYGGIRPYIGIGYHGSYMLTQATGLKIRNGHGAVGQIGVDFYAKDDTLINIDVRQFFLNPKLEYKPNLVGNKTMTSKVKLNPLIVSIGIGFTF

SEQ ID NO: 22743 - protein, 228 aa, Rickettsia bellii
MKKLLLIAATSATVLSSALSFADCGNDSWYLRVDAGAAMFNKEKDNQTGLKLKSNTAFTGDIGVGNYIAENFRADLTLGTTFSGKLKKSGAVSSLGGANISASHKPNITRLLINGYVDLSNFEMFDVFAGAGIGASMLKEKVSFSGINSGATVSTSYSSKNTTNLAYKLTLGASSQISDGVKAELAYSWISDGKTKGGNVKLFGLGNKQVKGIRYQSHNLTAGLRFDI

SEQ ID NO: 22744 - protein, 915 aa, Haemophilus influenzae
MKKAIKLNLITLGLINTIGITITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGASGINALAGSANFRTLSVNDVITDDKPFGIILKGMTGSNATKSNFMTTAAGRKWLDNGGYVGVVYGYSQREVSQDYRIGGGERLASLGQDILAKEKEAYFRNAGYVFTNGQWTPDLNKNHWSCNLPTPKLADSTQLNGINETSACRLYYKNSKRKEILKELEEKKDPSKITELQKDITETDKSFERNKDQYSVAPIEPGSLQSRSRSHLLKFEYSDDRHTLGAQIRTLDNKIGSRKIENRNYQVNYNFNNNSYLDLNLMTAHNIGKTIYPKGGFFAGWRVADKLITKNVANIIDINNSHTFLLPKEIDLKTTLGFNYFTNEYSKNRFPEELSLFYNDDSHNQGNYSYLGRFQGSKSGLPQRSVILQPSGKQKFKTVYFDTALSKGIYHLNYSVNFTHYAFNGEYVGYENKPTQINEPILHKSGHKKAFNHSATLSAELSDYFMPFFTYSRTHRMPNIQEMFFSQVSNAGVNTALKPEQSDTYQLGFNTYKKGLFTQDDVLGIKLVGYRSFIKNYIHNVYGVWWRDGVVPTWASSNGFRFTIAHQNYQPIVKKSGAELELNYDMGRFFANVSYAYQRTNQPTNYADASPRPNNASKDDILKQGYGLSRVSMLPKDYGRLELGTRWFDQKLTLGMAARYYGKSKRATIEEEYINGSRYENYTVGDRTYYAVKKTEEIKKQPIILDLHVSYEPIKDLIIKAEVQNLLDKRYVDPLDAGNDAASQRYYSSLNDSICSKGNTTCEDGGKDKTVLYNFARGRTYILSLNYKF

SEQ ID NO: 22745 - protein, 475 aa, Aquifex aeolicus
MDFSIMVYAVIALVGVAIGWLFASYQHAQQKAEQLAEREEMVAELSAAKQQITQSEHWRAECELLNNEVRSLQSINTSLEADLREVTTRMEAAQQHADDKIRQMINSEQRLSEQFENLANRIFEHSNRRVDEQNRQSLNSLLSPLREQLDGFRRQVQDSFGKEAQERHTLTHEIRNLQQLNAQMAQEAINLTRALKGDNKTQGNWGEVVLTRVLEASGLREGYEYETQVSIENDARSRMQPDVIVRLPQGKDVVIDAKMTLVAYERYFNAEDDYTRESALQEHIASVRNHIRLLGRKDYQQLPGLRTLDYVLMFIPVEPAFLLALDRQPELITEALKNNIMLVSPTTLLVALRTIANLWRYEHQSRNAQQIADRASKLYDKMRLFIDDMSAIGQSLDKAQDNYRQAMKKLSSGRGNVLAQAEAFRGLGVEIKREINPDLAEQAVSQDEEYRLRSVPEQPNDEAYQRDDEYNQQSR

SEQ ID NO: 22746 - protein, 248 aa, Coxiella burnetii
MLKKIVIGVTATAAFGIGAGALAGGSVDQSYNNTSGAGFYVRGEAGYGLVDKKSGTSKVNFTGVTLTENSHTNTKKSRGFNGRVAIGYAFNPYFSLESGFTYYHPAYRDVNIAGSALPLFSSVQAEGRQKINLYSIDLMGKATLPIDNFYAFIEGGVAYVHTKFAAFTETGTAVSPLLPPVTSSVAVKVPSSSKGYIRPKAGIGVGYNITQNIGVDVSYSRVFGQGKINNTNYLPNLNAVTLGLTYKF

SEQ ID NO: 22747 - protein, 224 aa, Rickettsia bellii
MKKLLLIAATSATMLSSTLSFADGMDNEWYLRIGAGAAMFNKEKDEATSVKLKSNMTVSVDLGIGYYFSKNFRTDLTLGTIIGGKLKKSGTATNVPFSGTNVSVSYKPTITRLLINGYVDLTNFNIFDVFAGAGVGPALVKEKITYNGITGLASTTKNRTNISYKLTLGTSAQIADDVKVELAYSWINDGKAKSKNVVYQGQKVQIGGMRYQSHNLTASIRFDI

SEQ ID NO: 22748 - protein, 289 aa, Rickettsia conorii
MKKLLLIAAASTALLTSGLSFADCDMNSSVDSSTNSSMSSSMENQWYLKLNAGGVIFDKAKPSNSSVKLKSNTGFTGNIGAGYYIMDNLRTDFTIGMVTNNHMKKSTNVSTSSSTVTTVPTVISAGGQLIINGVVIPGGVLTSGPGGTTTTTTATTVSVKHKPTIVSALLNGYVDFIDVSMFKVFAGAGVGAALVKEKVNISTKTVANNNVISSTNFSGTTKNKTNFAYQLSLGTSFEVAQGVKAELVYSWTDYGKSKTNTKNVVGNKVKFGGTRYKGNNLMAGLRFDM

SEQ ID NO: 22749 - protein, 227 aa, Rickettsia conorii
MLIMKKLLLIAATSATILSSSVSFAEGMDHEWYLRIDTGAAMFNEEKDKATGVKLKSNTTVPVALGIGYYISENFRADLTLGTIIGGKLKKSGAATNAPFTRTNVSASHKPTITRLLINGYVDLTNFDMFDVFAGAGVGPALVKEKITYNGITGLSSNTKNRTNISYKLTLGTSAQIVDGVKVELAYSWIDDGRTKSKNVIYQGTSVPTGGMHYQSHNLTAGIRFDI

SEQ ID NO: 22750 - protein, 197 aa, Rickettsia massiliae
MQKLLKVTMTSLVLLTMTYAEEMNENNMIEVETESESPFYIVTKGMVTPGGDMREEEALLEGDNAYGVGLDIGYMFHEHFGIEFSTVYGKNDITRTEEMHGEIEVDKAKATYVSYAINLIFKHPINEEFGYFIKAGYEKEHETIDDFNIDEKEHGVDAAAGLTYEINEKMAALVEYEYSSIRGLRGDAFFLGIEFEF

SEQ ID NO: 22751 - protein, 225 aa, Rickettsia felis
MKKLLLIAATSATILSSSISFAECMDNEWYLRVDAGVAMFNKEKDKTIGVKLKSNKAMPIDLGIGYYIAENVRADLTLGTTIGGKLKKSGAATNAHFTGTNVLVSHKPIVTRLLINGYVDLTSFDMFDIFVGAGVGPALVKEKISGASGLASNTTNTKNKTNVSYKLIFGTAAQVADGVKVELAYSWIDDGRTKSKHVIHEGASVQTGGMRYQSHNITVGLRFGI

SEQ ID NO: 22752 - protein, 938 aa, Haemophilus influenzae
MRFFCFGMLLPFTFVLANEGLQLPLETYITLSPEYQAAPQVGFTHNQNQDLAIVGNHNDFILDYKYYRSNGGALTCKNLLISENIGNVFFEKNVCPNSGGAIYAAQNCTISKNQNYAFTTNLVSDNPTATAGSLLGGALFAINCSITNNLGQGTFVDNLALNKGGALYTETNLSIKDNKGPIIIKQNRALNSDSLGGGIYSGNSLNIEGNSGAIQITSNSSGSGGGIFSTQTLTISSNKKLIEISENSAFANNYGSNFNPGGGGLTTTFCTILNNREGVLFNNNQSQSNGGAIHAKSIIIKENGPVYFLNNTATRGGALLNLSAGSGNGSFILSADNGDIIFNNNTASKHALNPPYRNAIHSTPNMNLQIGARPGYRVLFYDPIEHELPSSFPILFNFETGHTGTVLFSGEHVHQNFTDEMNFFSYLRNTSELRQGVLAVEDGAGLACYKFFQRGGTLLLGQGAVITTAGTIPTPSSTPTTVGSTITLNHIAIDLPSILSFQAQAPKIWIYPTKTGSTYTEDSNPTITISGTLTLRNSNNEDPYDSLDLSHSLEKVPLLYIVDVAAQKINSSQLDLSTLNSGEHYGYQGIWSTYWVETTTITNPTSLLGANTKHKLLYANWSPLGYRPHPERRGEFITNALWQSAYTALAGLHSLSSWDEEKGHAASLQGIGLLVHQKDKNGFKGFRSHMTGYSATTEATSSQSPNFSLGFAQFFSKAKEHESQNSTSSHHYFSGMCIENTLFKEWIRLSVSLAYMFTSEHTHTMYQGLLEGNSQGSFHNHTLAGALSCVFLPQPHGESLQIYPFITALAIRGNLAAFQESGDHAREFSLHRPLTDVSLPVGIRASWKNHHRVPLVWLTEISYRSTLYRQDPELHSKLLISQGTWTTQATPVTYNALGIKVKNTMQVFPKVTLSLDYSADISSSTLSHYLNVASRMRF

SEQ ID NO: 22753 - protein, 239 aa, Haemophilus influenzae
MKKLLISGTVLFLMASNYTYANNYKTTIEYRHQYLDASGKSGDRIKAFLDTGKNIGFELDARYGNKDGAYDAMKIDGSEFSAFYYTKLNSNLVGLVGSSLDFDKQGLVYVPYVRLNYTFDNGIRLQGRYKWKVWDYGQVGENGSNYHSKIQEFDSWIGYKWGKLDLQYQLDLMWEMADNAQPLYNNKKFDYQHNVRLRYDIKTDDGALWRPFVEVGNVKESKFSSDRQTRFRVGIQYTW

SEQ ID NO: 22754 - protein, 483 aa, Haemophilus influenzae
MDLGGKGGALNFDEVSQRYLNKPLSTKVVFQLVKDLTDLLYRSGYVTSAIGLKNPKIKNGDLEFVVLWGTVNDILVAGEKATHFRDKAMLAVLPNLKNKLLNVYDIDQMVEILNTTNKSAKVSVVASQEKGASNLNIERVRNDWPEVTLSINNSGTENNANGRNQASLNVAWSDLLGTNDRWSFSTGYRFYKHSKANQQRNYALSYVQPLSFSTLELKLAESEYKKSLQGENDVYTSSGKTQTATLKLSHVLLRNKETILSVYGELEFKKRLSYFSDIEIGDYHNNKLNIGLSYVTNLGYGKLYSDIAYANGLRWFGADYSAYDTKREKTLKLLSGSVNWLRPIVMFDRSLTYQARIGAQYGFDSLYSENQFSIGDEYTVRGFKGGAASGDSGAYFSQTLSIPFYPQKAYLSQISPFVGVDIGKVHVKQSHQTDTLAGFALGVKGQVRLFNFSFTYAQPLNTVRKVKPQDKKPVYYVSGSVSF

SEQ ID NO: 22755 - protein, 922 aa, Neisseria meningitidis serogroup B
MRSSFRLKPICFYLMGVMLYHHSYAEDAGRAGSEAQIQVLEDVHVKAKRVPKDKKVFTDARAVSTRQDVFKSGENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRGVAQNYRVGGGGQHIGNFGEEYLERRKQQYFVQEGGLKFNAGSGKWERDLQRQYWKTKWYKKYEDPQELQKYIEEHDKSWRENLAPQYDITPIDPSGLKQQSAGNLFKLEYDGVFNKYTAQFRDLNTRIGSRKIINRNYQFNYGLSLNPYTNLNLTAAYNSGRQKYPKGAKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNAINYRFGGEYTGYYGSENEFKRAFGENSPAYKEHCDPSCGLYEPVLKKYGKKRANNHSVSISADFGDYFMPFAGYSRTHRMPNIQEMYFSQIGDSGVHTALKPERANTWQFGFNTYKKGLLKQDDILGLKLVGYRSRIDNYIHNVYGKWWDLNGDIPSWVGSTGLAYTIRHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNVRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 22756 - protein, 721 aa, Brucella melitensis
MKRFYLLSVISLFSAGISAQEITGGERTLSADSIITSDARLDSIYQSLPEVMIIGERPVVKASQGKLVYDLPQLIRDLPVDNAYDAVKELPGVTEMNGGLQLAGQGVTVILNGKVTTLSVEQLYTLLRSIPASRIEKAEVMYNAPARYQVRGALINVQLKQTADGPSSWQGELYGKYNQKHYEGFEERASLLYNGNKFSTDFLYSHKHGRTYTTTDKDAMHALADGSVYPMATDEVRRARSHTHSFRVGADYTIAKDHQLSFVYNGNYTTSHNRMNINGSQQSATLSNSTDWLHNGRLDYSTPFGMKAGVEFTYYRSPSDQLLNSRLLENDELDFFTQDCQRINRWKMFLAQEHSLGKGWGLNYGIVYTTGIDNSYQYYYDPETGEQLGDENTTSLAAGDNSAGNFTNMKSRKREETLNIYAGFSKSFGDKLSLDASLAVERYKTPVWNQWDWYPTVNLNYMPAPGHILQLALSSDKHYPDYWAVQDAVSYIGGGYSEIHGNPLLKPAQSYEFQMNYILKGKYIFSTWFSHTKDYSVQTLYQSSQRLVEIYKYLNFDYRQQFGIQASVPFKVKNWLNSRLTFIGIWHREKDSDFWDIPFDRKQCYGIAQMNNTFTLSTKPDLKLTVTGFVHSKAIQGIYDLPVSGNVNAALRYGFAKGKAVLNLYCNDIFETGQISPRIRFQTQNVTNHYSCFRELGVSFTYKFGGYKEKKREGVDTSRFK

SEQ ID NO: 22757 - protein, 70 aa, Haemophilus influenzae
MPIGGDVKADQETSGSRSIKRIGFGFIGGIGYDITPNITLDLDYRYNDWGRLENVRFKTHEASFGVRYRF

SEQ ID NO: 22758 - protein, 1153 aa, Anabaena sp.
MSNLIIYYKLINYKCMDNIMKCTPLGEQKSLWLRKTLLIMKFFVLFLLLGTIPCWAGVAYSQNVKMSLDMENTTVHDVINAIEKKGEFYFTYNLNQINVNRKVSIKVENKTINQILDQLFSKSGIDYKIENRHIVLYKQAASEVEAVKQQKSINGIVADEQGEPIIGASVLEKGTTNGTITDLDGRFTLSIGKGTELIVSYVGYTTKTVKIGNQSTIKIVLIEDTKTLDEVVVIGYGTQKKSDVSGSVTSVSGDKLSKIPTANAEMALQGMAPGLSVNFGSGAAGSSATLQVRGVTSWKDDDGENSESNGPLVIIDGVPGNMSYLNPEDIKSISVLKDAATAAIYGSRSAAGVILIETHRGTMNSAPKITFSGYWGLSAVPKRLEVCNSAEFIKVRKMALINAGTDESRWPKYISEYERDPSQFADTDWQKEYYQRGFTQKYNIGYTAGSANSNVSLSAFYSKTDGVTIATGDEKFGFRLNSDVTRGKFKMGESVSYSRWSADLESNSGFSSIYQVTNMEPLAFLYDENNDGGYGGAISGMGMSDAGNQVAFNKLIDNTSSNDYIAASGYLQYEPIKGLIVKFNASRNMYFGKSRLFKPTYEIGAAKRNTMASLSESRSQTTNDLLELTANYDKTIAEKHNLSLLLGLSQEENKYEDLSASGSDFENNSMSLMGHAKSNYSVGGTKTRSALRSLFGRVNYNYMMRYMIMASFRYDGSSRFAKGNKWGFFPSVSLGWNIANEPFWENLKETVSMFKFRLSYGALGNQNIGLYRYIPTLSYNNHALNYPFDGRETSMGYAITAFPSSDIKWETTVYKNIGVDISLWNNKLELSAEAYIKNTSDMLSSRNISLATGYNSSILVNDGKLRTTGFEMQAIYHGKAGGLKYDLDLNLSHYKSVLKSMANPDYLYEYGALRTYVGGEIGEFWVYQTAGIFQNQAEVDEWNTAHGYKDQNGNWQPLQPVAKPGDIRFIDQNGDGMLDTNDRVKVGSGTPKVSLGFNINLAYKDFDLVANFYGDFGAKRYNYTKYQLERMDHVFNYGKNALNAWTPENPDTDIPRAVSGDPNKNSRTSTRFVENGDYLRLNNLQIGYNLPVKYCKKMGLSNLRIYVGATRLFTITNYKGYDPSTGSSVGQMGYDYAAIPLSRDFMMGLKFGF

SEQ ID NO: 22759 - protein, 242 aa, Rhizobium sp.
MSRMLLSCLCVSILSASPAGADGPIRWHSENVQILKGLNYELGPEERTIITVEHAHTSDIGDLFLFTDFTFEPDGDIQAYGEITPRLSLSRLTGRDWRAGVFSDVLLAANYERGEGGVERYLAGAAIDLDIEGFRFVRVHAFLRDDPSRSGTTGQLSIAWNRPFEIGGEAFLAEGFADLAGAEGNGVANQLLVPRLLWDIGAHHGAAGRVYLGLEWQYWHNKFGVDGVTESVPQIQLKWVLH

SEQ ID NO: 22760 - protein, 224 aa, Rickettsia canadensis
MKKLLLIAATSATILSSSVSFAEGVDHEWYLRIDTGAAMFNEEKDKATGVKLKSNTTVPVALGIGYYISENFRADLTLGTIIGGKLKKSGAATNAPFTRTNVSASHKPTITRLLINGYVDLTNFDMFDVFAGAGVGPALVKEKITYNGITGLSSNTKNRTNISYKLTLGTSAQIADGVKVELAYSWIDDGRTKSKNVIYQGTSVPTGGMHYQSHNLTAGIRFDI

SEQ ID NO: 22761 - protein, 222 aa, Rickettsia akari
MKKLLLIATASATILSSSVSFAECIDNEWYLRADAGVAMFNKEQDKATGVKLKSNKAIPIDLGIGYYISENVRADLTLGTTIGGKLKKYGAATNTHFTGTNVSVSHKPTVTRLLINGYVDLTSFDMFDVFVGGGVGPALVKEKISGVSGLASNTKNKTNVSYKLIFGTSAQIADGVKVELAYSWINDGKTKTHNVMYKGASVQTGGMRYQSHNLTVGVRFGI

SEQ ID NO: 22762 - protein, 1136 aa, Aquifex aeolicus
MLKRLKSVSMLLFLMGASTGAAYAVANPGVTDVKITQQSGTCTGIVKDATGETVIGASVVVKGTTNGTITGLDGDFSLSNVKKGDIIVISFVGYQTQEVKWTGQPIDVTLKDDTQQLGEVVVTALGLKREEKALGYAVTEVKGDELKAANTISPVAALQGKVAGVEISGSDGGLFGGTKIQIRGASTLSSNNQPIYVVDGVILDNGVSGNTTADWDAGANNASDYGNELKNLNPDDFETVSVLKGAAATALYGSRGLNGAVVITTKSGKGTQGLGISVSQTFGIDHAFKTPDIQTLYGPGYMPGQSDADQNGSMWDEHQFTVNQNGEHTLVGVPNFGFGPRYDGSQIRNYDGTWTTYSPRKNNMLDLYKLGFNTNTNVSIRGGNEKTSFYTSLSYKNAKSTTENNTFERYSMLLKASHKLNDWVDVAASFSFANSKPRNAQLNAGELFVNANTNVINPLFDVDYFRNKYLGEHGGIASTSYGDQYGSVPSSAKNYFFKVDNYDYVRKETVIRPTFEVNVKMTDWLKFKADANMNRYYTSIEDKQLGSGYANEGGYYGITQDIKEQFTVGGTFTASKQIKDFSLGGFARFEYYNTSSQHSKVSTDGGMVVPGEWFVENSKKTKKSESTISGSKRIISAIFALNLGWKNQFYLDVTGRNDWSSALVYANRTGNHSYFYPSVSGSWLINETFRESMPSWINLAKLRASWAQVGNDTDPYAVNQTYSFATMEMYDGNIYTNELDKLMKIADLKPERKNSWEIGLDFRTFNNRLNLDFTYYKENTTDQIMKINVPAISGVTQQLVNAGNIQNSGIEIALNTTPIKTKDWQWDLDFTYTRNRSKIVSLHPNVANYIELSGYVNAYDYHIGSVAKVGESYGVLMSDVTQARNENGVPLLEWDDSWRGAYRAQSKTAEVVGNMTPDFLGSVATTLTWKDLSLNVGLDMRFGGLVASYCNLYGTQAGWTESSLQYRDPEHGGMTWTSQYADSKGIQYTDGMIPEGVFKEGTIATLVDGTKMDVSGLSYAQLVQEGKLEPTHAGSWYGNNYAWGAQTIDDIWVHKLSYIALRNITINYRLPNSISHKLGAKGLNLSFSARNLGYLYNSLPNNLNPESVRSNSASEFRIRGFEPYTASYIFTINANF

SEQ ID NO: 22763 - protein, 224 aa, Rickettsia rickettsii
MKKLLLIAATSATILSSSISFAVDMGNDWYLRIDAGAAMFNKEKDKATGVKLKSNTTVPVDLGIGYYISENFRADLTLGTIIGGKLKKSGAATNAPFTGTNISASHKPTITRLLINGYVDLTNFDMFDVFAGAGVGPALVKEKITYNGITGLSSNTKNRTNISYKLTLGTSAQIADGVKAELAYSWIDDGRTKSKNVIYQGTSVSTGGMRYQSHNLTAGIRFDI

SEQ ID NO: 22764 - protein, 658 aa, Synechocystis sp.
MGLGYGSASLAQETPGQEGFLGTLTLGESKRAVQTDTATPTTVIDQDEIRDRQAGSVAELLVTVPSVALLNGDTAQGSGISIRGFGSNDTFGTDQKVLIQVDGATRGSEELYRIGTQLFTDPFLFKEVEVIRGTVGSFQYGSGVVGGVVRLETIDPEDVTGGETGFGLRQTLEFQTNGNGVTSSTIGAWQPTEDFGVLFNYVSRRLGFPEDGNGAVINPLRARIDDPSWLIKAKYRFGEDKAHSIEASYQDTQSSQFDVPFDSFGNLTFFGNVDREVESQTSILKYNFNPLNDLVDLTLQYSHVDESILQNAVSCPGSPPAPITICSELLNADHDYETTTLTLKNTSLFDTGALRHDLTAGIEYINRERVNAFAAPGGEDNRWAIFAVDEIDIGRAWTLTPAIRYETSKVEGDTAPNDGRFSEDALMGGLSLRYAFDNGFALFGSAAYTEVLPIIDDLEFPIRVGRSEKSRTYELGFSYDRRGLWRDNDNLALKVTYFDSELWDVNSFVDTTPAQNLLDEIQTQGLEFEASYAMENGFYVDFNATVADGEEVDLLGGVRDWRNLAANSLRATVGKVFDDTYDLSWEVVSADSITVNGVRDDGYTVHNLRGTIAPKRGVWEGTEFRLGIENLFDEQYMPNLATRPAVGRNFKLTLAKTF

SEQ ID NO: 22765 - protein, 246 aa, Rickettsia typhi
MKKLLLIAAASTALLTSSISFADCDIDSSTNSSMSSSIENQWYLKLNAGGVMFNKMKPKGKDFKLKTNTGFVGNVGVGYYIMDNLRTDLTIGAVTSAHLRKSTTGKNSTDSSSTLKHKPTIVSALLNGYIDFVDLSMFKVFAGAGVGLAMVKEKVTGKEAIAIVSDKNTISNDHHLTTKNKTNFAYQLSLGTSFELAQGIKVELVYAWIDYGKTKTTTKTIHDVQYKYGGTRYKGNNLMAGLRFDI

SEQ ID NO: 22766 - protein, 248 aa, Rickettsia prowazekii
MKKLLLIAATSTALLTSGISFADHDMNCSVDSSTNTSMSSSIEKQWYLKLNAGGVMFNKTKPKGKDFKLKTNTGFIGNVGVGYYIMDNLRTDLTIGAVTSAHLKKSTTGKSSAGSSSTKSIKHKPTIVSALLNGYVDFIDLSMFKVFAGAGVGLAMVKEKVTGKEAIAIVSDKNTTSKDHNHNTKNKTNFVYQLSLGTSFELAQGIKVELAYAWIDYGKTKTIHGVQYKYGGTRYKGSNLMAGLRFDM

SEQ ID NO: 22767 - protein, 719 aa, Caulobacter crescentus
MTIDRILRSAALLTLAAAGAPALAAPRPTGTEAPARPAPADVLALPELIIAGWRDGATTEGSGSFTSDAVTVAGKAPVRRIDVPYSVSVVTRRQIEDQTLTTVDEALARATGVTRISNEPSQSQYLIRGYDPQAMSDGVPVLGGLSGYQQLDTVLYDRIEVLRGPAGLLLGQGEPAGVVNFVRKRPRETFGASLATSYGSWANKRVELDLTGPLGGESGVRWRGILAGTDRDSSFRDGHGTRGLGAGMISIDLTPRTTLSLSAVRQGDLSPSFSGLPADAATRRFLRVPRDTNPYPAWARNQWTTQEYAAELEHRFGEWVLRAAYVRRLQDFAFKDAYPVTGTDPAGNAKYARRWSIWSYDREGADLSVQGPVEAFGRRHEVLLGMNAMSWSQAGRRVNYPQVDGNIFDPNAGVAEPFGPFTRGSRNLQEQWGVYGQTRLRLLDPLTLVLGGRLSSYEARSRAAAPSRGTPWETDTSATARPSPYGALVYELTPGLNAYASYADIFLPQTDPKWPSGVIDPRVGTQYEVGLKGEALEGRLQASAALFRIDDVNRAFDDAAHPNYSVALGKARSEGVEVEVSGELLPGWQAVAGYTYARTELLRDDSRTGARLTNWLPKHSVKLWSQYDVQEGPLRGVFVGLGLVAASTTSDQGRVPVRFQPPYAVLDLQIGYAVNRTLKATLSVNNVLDTVYRTRIGGLNTYNTYGDPRNVMLTLRATF

SEQ ID NO: 22768 - protein, 461 aa, Neisseria meningitidis serogroup B
MAQTSSDTVRDASEASGADANKTPANETGLWNRDQLFGDMGGLRPWLGQYGVTFALTETSELLGNLRGGLARGVAYDGLTTATLQLDTEKAFGLPGGQFNVSALQIHGRNLSTDKLGTLNTASGIEADASTRLWELWYQQSFLNKRVDVKIGQQSIDQEFISSTYSALFINTMFGWPALPSYDMPSGGPAYPLSALGVRVRGQITPSLTALAGVFDGDPLGNNPNNRSGTNFNLHNGTLFIGELQYAINQPADSDAAAAPGAAPGATRGSLPGTYKIGLWYNNGPFADPRYDNNGVSLASPASSGVAANHRGDYSFYAVADQTIWRPNPGEARSLGIFARVMGAPGDRNLVSLAANLGVVLKAPFAGRDNDSAGLALTYIKIGSHTRGIDQDNLAFSGGPYGVRTSETALEATYQYQIAPWWMLQADAQYTFNAGAGQNPNDPTKPLRNTFVVGVRTNIAF

SEQ ID NO: 22769 - protein, 486 aa, Escherichia coli
MHSWKKKLVVSQLALACTLAITSQANAANYDTWTYIDNPVTALDWDHMDKAGTVDGNYVNYSGFVYYNNTNGDFDQSFNGDTVNGTISTYYLNHDYADSTANQLDISNSVIHGSITSMLPGGYYDRFDADGNNLGGYDFYTDAVVDTHWRDGDVFTLNIANTTIDDDYEALYFTDSYKDGDVTKHTNETFDTSEGVAVNLDVESNINISNNSRVAGIALSQGNTYNETYTTESHTWDNNISVKDSTVTSGSNYILDSNTYGKTGHFGNSDEPSDYAGPGDVAMSFTASGSDYAMKNNVFLSNSTLMGDVAFTSTWNSNFDPNGHDSNGDGVKDTNGGWTDDSLNVDELNLTLDNGSKWVGQAIYNVAETSAMYDVATNSLTPDATYENNDWKRVVDDKVFQSGVFNVALNNGSEWDTTGRSIVDTLTVNNGSQVNVSESKLTSDTIDLTNGSSLNIGEDGYVDTDHLTINSYSTVALTESTGWGAD

SEQ ID NO: 22770 - protein, 147 aa, Escherichia coli
MNTIHLRCLFRMNPLVWCLRADVAAELRSLRRYYHLSNGMESKSVDTRSIYRELGATLSYNMRLGNGMEIEPCLKAAVRKEFVDDNRVKVNSDGNFVNDLSGRRGIYQAGIKASFSSTLSGHFGVGYSHGAGVESPWNAVAGVNWSF

SEQ ID NO: 22771 - protein, 1951 aa, Escherichia coli
MQRKTLLSACIALALSGQGWAADITEVETTTGEKKNTNVTCPADPGKLSPEELKRLPSECSPLVEQNLMPWLATGAAALITALAVVELNDDDDHHHRNNSPLPPTPPDDESDDTPVPPSPGGDEIIPDDPDDTPTPPKPISFNNDVILDKAEKTLTIRDSVFTYTENADGTISLQDSNGRKATINLWQIDEANNTVALEGVSADGATKWQYNHKGELVITGDNATVNNNGKTTVDGKDSTGTEINGNNGKVIQDGDLDVSGGGHGIDITGDSATVDNKGTMTVTDPESIGIQIDGDKAVVNNEGESTITNGGTGTQINGDDATANNSGKTTVDGKDSTGTEINGNNGKVIQDGDLDVSGGGHGIDITGDSATVDNKGTMTVTDPESIGIQIDGDKAVVNNEGESTITNGGTGTQINGDDATANNNGKTTVDGKDSTGTEIAGNNGKVIQDGDLDVSGGGHGIDITGDSATVDNKGTMTVTDPESIGIQVDGDQAIVNNEGESTITNGGTGTQINGNDATANNSGKTTVDGKDSTGTKIAGNIGIVNLDGSLTVTGGAHGVENIGDNGTVNNKGDIVVSDTGSIGVLINGEGATVSNTGDVNVSNEATGFSITTNSGKVSLAGSMQVGDFSTGVDLNGNNNSVTLAAKDLKVVGQKATGINVSGDANTVNITGNVLVDKDKTADNAAEYFFDPSVGINVYGSDNNVTLDGKLTVVSDSEVTSRQSNLFDGSAEKTSGLVVIGDGNTVNMNGGLELIGEKNALADGSQVASLRTGYSYTSVIVVSGESSVYLNGDTTISGEFPLGFAGVIRVQDKALLEIGSGATLTMQDIDSFEHHGTRTPELTYADSGAKIVNKGTVEIQNLGFAFVTGENTTGINSGTISLLQNGKDPAPSPIVLLATNGGSATNAGTITGKVTERHSVFNKYSTGTSNSFIFNNDVSSITGLVAQSNSTIINTDSGIIDLYGRGSVGMLAIADSTAENQGKITLDSMWVDANDTTAMRDIASNSAIDFGTGVGVGTDSYSGAGKNATAINQLGGVITIYNAGAGMAAYGASNTVINQGTINLEKNGNYDDSLAANTLVGMAVYEHGTAINDQTGVININVGTSQAFYNDGTGTIVNYGTICTFGVCQSGNEYNNTDDFTSLIYTGGDTITRSGETVTLNNAGEMTAQITMNAGADSSLVNNTGTINKIVQNAGVFNNSGSVTGRMMSAGGVFNNQTDGAIMRGAALTGTAVANNEGTWNLGSSSEGNNTGMLEVNNNSAFNNRGEFILDNDKNAVHINQSGTLYNTGHMNISNSSHNGAVNMWGGNGRFINDGTIDVSAKSLVVSANNAGDQNAFFWNQDNGVINFDHDSASAVKATHSNFIAQNDGIMNISGTGAVAMEGDKNAQLVNNGTINLGTAGTTDTDMIGMQLNANATADAVIENNGTINIFANNSFAFSVLGTVGHVVNNGTVVIADGVTGSGLIKQGDSINVEGMNGNNGNSSEVHYGDYTLPDVPKPNTVSVTSGSDEAGGSMNNLNGYVVGTNVNGSAGKLKVNNASMNGVEINTGFTAGTADTIVSFDNVVEGSNLTDADAITSTSVVWTAKGSTDASGNVDVTMSKNAYTDVATDASVNDIAKALDAGYTNNELFTSLNVGTTAELNSALKQVSGSQATTVFREARVLSNRFSMLADAAPKVGNGLAFNVVAKGDPRAELGNNTEYDMLALRKTIDLSESQTMSLEYGIARLDGDGAQKAGDNGVTGGYSQFFGLKHQMSFDNGMNWNNALRYDVHNLDSSRSIAFGNTNKTADTDVKQQYLEFRSEGAKTFEPSEGLKVTPYAGVKLRHTLEGGYQERNAGDFNLNMNSGSETAVDSIVGLKLDYAGKDGWSASATLEGGPNLSYAKSQRTASLAGAGSQHFNVDDGQKGGGINSLTSVGVKYSSKESSLNLDAYNWKEDGISDKGVMLNFKKTF

SEQ ID NO: 22772 - protein, 395 aa, Escherichia coli
MKRKVLAMLVPALLVAGAANAAEVYNKDGNKLDLYGKVDGLHYFSDDSGSDGDMSYARIGFKGETQIADQFTGYGQWEFNIGANGPESDKGNTATRLAFAGLGFGQNGTFDYGRNYGVVYDVEAWTDMLPEFGGDTYAGADNFMNGRANNVATYRNNGFFGQVDGLNFALQYQGNNESSGPFGQEGSGNGKGRGITKENGDGFGMSTSYDFDFGLSLGAAYSNSDRTDRQVHKGTHNTRDGDRFDATAGGETAEAWTVGAKYDANNVYLATMYAETRNMTGYGDADAIANKTQNFEVVAQYQFDFGLRPSIAYLQSKGKDLGGVSSDNYDSKGNHHYANKSLVKYVDIGATYYFNKNMSTYVDYKINLLDNDDNFYKENGIATDDIVAVGLVYQF

SEQ ID NO: 22773 - protein, 1528 aa, Escherichia coli
  misc_feature (960)..(960): Xaa can be any naturally occurring amino acid
MNRTSPYYCRRSVLSLLISALIYAPPGMAAFTPDVIGVVNDETVDGSQRVDERGTTNNTHIINHGQQNVYGGVSNGSLIESGGYQDVGRHNNYVGQSNNTTINGGRQSIHDGGISTGTIIESGNQDVYKGGISNGTTIKGGASRVEGGSANGTLIDGGSQIVKVQGHADGTTINKSGSQDVVQGSLATNTTINGGRQYVEQSTVETTTIKNGGEQRVYESRALDTTIEGGTQSLNSKSTAKNTQIYSGGTQIIDNTSSSDVIEVYSGGVLDVSGGTATNVTQHDGAILKTNTNGTTVSGTNSEGAFSIHNHVADNVLLENGGHLDINAYGSANKTIIKDKGTMSVLTNAKADATRIDNGGVMDVAGNATNTIINGGTQNINNYGIATGTNINSGTQNIKSGGKADTTIISSGSRQVVEKDGTAIGSNISAGGSLIVYTGGIAHGVNQETGSALVANTGAGTDIEGYNKLSHFTITGGEANYVVLENTGELTVVAKTSAKNTTIDAGGKLIVQKEAKTDSTRLNNGGVLEVQDGGEAKHVEQQSGGALIASTTSGTLIEGTNSYGDAFYIRNSEAKNVVLENAGSLTVVTGSRAVDTIINANGKMDVYGKDVGTVLNSAGTQTIYASATSDKANIKGGKQTVYGLATEANIESGEQIVDGGSTEKTHINGGTQTVQNYGKAINTDIVSGLQQIMANGTAEGSIINGGSQIVNEGGLAENSVLNDGGTLDVREKGSATGIQQSSQGALVATTRATRVTGTRADGVAFSIEQGAANNILLANGGVLTVESDTSSDKTQVNTGGREIVKTKATATGTTLTGGEQIVEGVANETTINDGGIQTVSANGEAIKTTINEGGTLTVNDNGKATDIVQNSGAALQTSTANGIEISGTHQYGTFSISGNLATNMLLENGGNLLVLAGTEARDSTVGKGGAMQNQGQDSATKVNSGGQYTLGRSKDEFQAXARAEDLQVAGGTAIVYAGTLADASVSGATGSLSLMTPRDNVTPVKLEGAIRITDSATLTIGNGVDTTLADLTAASRGSVWLNSNNSCAGTSNCEYRVNSLLLNDGNVYLSAQTAAPATTNGIYNTLTTNELSGSGNFYLHTNVAGSRGDQLVVNNNATGNFKIFVQDTGVSPQSDDAMTLVKTGGGDASFSLGNTGGFVDLGTYEYVLKSDGNSNWNLTNDVKPNPDPNPNPNPNPKPDPKPDPKPDPKPDPTPEPTPTPVPEKRITPSTAAVLNMAATLPLVFDAELNSIRERLNIMKASPHNNNVWGATYNTRNNVTTDAGAGFEQTLTGMTVGIDSPNDIPEGIATLGAFMGYSHSHIGFDRGGHGSVGSYSLGGYASWEHESGFYLDGVVKLNRFESNVAGKMSSGGAANGSYHSNGLGGHIETGMRFTDGNWNLTPYASLTGFTADNPEYHLSNGMESKSVDTRSIYRELGATLSYNMRLGNGMEIEPWLKAAVRKEFVDDNRVKVNNDGNFVNDLSGRRGIYQAGIKASFSSTLSGHLGVGYSHGAGVESPWNAVAGVNWSF

SEQ ID NO: 22774 - protein, 757 aa, Chlorobium limicola
MRVSRLLLSAAVCALVPSFAFAQNSGQADSGLEEIIVTAQKREQNMQDVPVAVTALSAETLTNRNVASVADLPRLAPSLTLTQGNVPTNNSLNLRGIGTIAFSTAIEPSVAVVVDDVALLQQAQAFSGLSDISRIEVLRGPQGTLFGKNASAGAVNIVSQGASDVFTGAVTGTATTDDEYRVDASLAGPLGENAGFRVNAFYGDRKGYIRNLEDGSRLNNDKSYGFRGRLELKPTETIKVDLIASHSISESDGFARTFRAAPTGAAVFGTPLTDSLVGITPGEDNYSVRLDKPLFNKSKQTTVSGRATLDLGFADLISVTSYQDWRFQFEEDFDYTVSDVLGIPGGIVADSTYHATQFAQELRLVSPSKGRFSYVLGLFYADGKTDREFERGPSGPVVASWASQSRTESYAAFGQATFNLTDTTHIDAGVRFNHEKVGASFLNRVPNASPPADNATCLTTCVGNAKDSVVTWKTALRQDIGDAVMVYASFARGYKGQGFDISTGFNPRRAAFPVRPETSNAYEVGIKSRFLDNKVQLNIAGFWSDFRDFQAQSGILLPDNTVLLTLNNVGKVRTRGIEAELTAKPTAALTLDSAVSFTDTRIMEFPGAQCYTGQTTGCVDLDGDGPATVKGQDLAGKRLPNAPRLKFNAGFNYDVFLPSAPFDAFVQADVSYQSKVNFDLLGNPLTVQDGYAVVNGSIGIDQNERGGMRVALFVNNLFDKHYASNVSIASGGSAGLLSQALDRKSRRYFGIRARYQF

SEQ ID NO: 22775 - protein, 700 aa, Pseudomonas putida
MRKALMWLPLLLIGVIPATWAVTPEAWKHTAYAYDARQTELSTALADFAREFGMSLDMSPVQGNLDGRIRAQNPEEFLERLSQEYHFQWFVYNDTLYVSPSSEHTSGRIEVSPDAVDDLQTALTDVGLVDKRLGWGSLPDEGVVLVRGPAKYVEFVRDYSKKVEKPDEKADKQDVVVLPLKYANAADRTIRYRDQQLVVAGVASILQELLESRSRGESIDSVNLLAGQGSSVANSTGVAAPACLTTWAPMVSIREHCNRGIAPRIELQQQKNCQGSCLRQGNIRVSADVRNNSVLIYDLPERKAMYQKLVKELDVPRNLIEIDAVILDIDPNELAELSSRLEFQCPAASEVGANLFDGGTSSTLFLQNASKFSAELHALEGNGSASVIANPSILTLENQPAVIDLSRTEYLTPTSERAADILPITAGTSLQVIPRSLDNDGKPQVQMIVDIEDGQIDVSTINDTQPSVRRGNVSTQAVIAEHGSLVIGGFHGLEANDRIHKIPLLGDIPYIGKLLFQSRSRELSQRERLFILTPRLIGDQVNPARYVQNGNPHDVDDQMKKIKERRDGGRLPTRGDIQKVFTQMIDGPAPEGLRAGQTLPFETRSLCDPGEGLTLDGQRSQWFVKKDWGVAVVVARNNTDKPVRIDESRCGGRWVIGVAAWPHAWLQPGEESEVYIAVRQPQISKMAKESRPSLLRGAKP

SEQ ID NO: 22776 - protein, 925 aa, Escherichia coli
MCESARHMRPFKAPSAMRLAVSEALLLAVAMTASAARAQPADDPPPEGDVGGASVPRGGAGAVVVPQPGTAQPAQPAAVSPPKLITYAPPVYPEEAQRAGVEGSVILKLDIDKTGRVTKAEVQTPGGHGFDEAALAAAPGLVFEPARRPDGTPAPARILYRYAFTLTPKPADAAAPAPPADVETVVGTVLSASTGEGLPDISVSLLRPDGGREDVKTDQRGKFRFKNLPPGKYRVEVAAAGFEPFTAEEDIAEGEAIEVRYRISLAKPKDGAAPGIEVTVQGERPPREVTRRTLERREIDRIPGTGGDALRSLQSLPGVARSGFGLLIVRGSAPQDTLTFIDRTPVPIIYHFGGLSSVVPTEMLEKIDFYPGNFSAVYGRAMGGIVDVGLRSPKQDGKYHGVVQLDLIDGRVLLEGPVPYLKDWKFIAAGRRSWVDAWLGPVLKEAGSSVTQAPVYYDYQFVLEGRPSASERVRASFYGSDDAFKITLDKPPEDEPALTGDFGLHTAFQRFQVSYENRLGNRDRILWSLALGRDVFDFGIAPFAFNITTASLDLRLEYSHRFARFLTMNVGTDLTSGIATVKLHAPTRQPAGHPSNQPFSTLPAQDQSFDGPYSRPAAYAEFEVVPSPRARIVPGVRVDYALDTRTLDVSPRINARYDIRSGFPRTTAKGGVGLYYQAPQFQESVEPFGNPDIKSNRSIHYGLGVEQEITPQIDVTVDGFYKQLDRQVVFSAEKDGYANDGTGYAVGGEVLLKYKPDERFFGWAAYTLSRSVRTDGPGEEEHPTPWDQTHVLTVLGNLQLGRGWEVGARFRLVSGNLETPYVCDPEQKGCDPNRVNAIYHASSGKYSPFPLGGDYSERMPLFHQLDVRVDKTWRFKRWQLGLYLDVQNVYNHQAAEGISYNFNFTKREYVTGLPFLPTLGLRGDF

SEQ ID NO: 22777 - protein, 992 aa, Escherichia coli
MNCNILNLRHLTVLLILCTAFLGGAIPAFAQQGGKKMTGQVIDENKEPMIGVSILIVGTSTGTVTDFDGNYTLNVPKDSKELQFSYVGYETKVITIPVNSNVLNVQMKSDSQVLSDVVIIGYGTQRKSDLTGSVASVGTKDFNKGMVSSPEELVNGKIAGVQIVNGGGSPTSVSTIRIRGGASLNASNDPLIVLDGVPMEVGGSISGGGNFLSLINPNDIESMTVLKDASSTAIYGSRASNGVIIITTKKGSGSDIKVSFQTTNSIATKTKTSDMLNTDEFINIVNQYGTEHQKSLLGDYRTNWNDEIYQTAFGTDNNLSVSGLALPWLPFRVSTGMYYQDGILKTDNTKRFTGNVNLTPSFFHNELRFNIGLKGTYSKNRFADTDAIWAGSTLNPTIPVYSGNDTFGGYNEAIDANGVPVTGALANAVGRLNQYDSTSDVYRFIGSASVDWNVRWVKGLRLHTTGGYDWSKGKGHIYVPKEAVSYYTTGGRDYTYGPQKNYNKLLTIYANYHNDFDAIHSGIDVTVGYDYQFWKYTTPFYAILSADGVQQSTSAATDQRHSLMSYYGRLNYTFMDRYLLMATMRRDGSSRFASDNRWGTFPSVALAWRVSQEHFFEPLRTVMNDVKLRVSYGITGQQDGITNYGYIPVYTPGLDGAQYLFGGNPIYTYRPEAYNPELKWETTKSWNYGIDLAFLENRFTFSADFYTRKTENLLATVPMPAGTNFDKLMLQNVGNVDSKGLELSVTGHIINTKNWSWTASANAAWQKVRIKNLTLTPGAPSPDTEVGPWIDAYQMQVFSTDYAPYSFYLYKQLYDAETGQPIEGLYADLDGDGEITNKDRYHHHSPAPDWILGFSTSLRYKKWTLSTSLRANIGGYIFNGMAMNTGAWETMSYNDYQLNNLNRSFLDTRFTKRQFLSDHYLENASFLKMDNLQLSYDFGRIYKTIGLHASAMVQNVFTVTKYKGVDPETANGVDTSVYPRPRTYSITIGLNF

SEQ ID NO: 22778 - protein, 458 aa, Artificial sequence
  L8fxa #1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKIEGRNVGYKNYGYGEDGKHHETNLEAKYVVQSGPAKDLSFRIRQAWHRANADQGEGDQNEFRLIVDYPLSILGGHHHHHH

SEQ ID NO: 22779 - DNA, 1377 bp, Artificial sequence
  L8fxa #1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagattgaaggcagaaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22780 - protein, 463 aa, Artificial sequence
  L1rek polypeptide sequence
MVMSQKTLFTKSALAVAVALISTQAWSAGFHMFVSDQAEAKGFIEDSSLDLLLRNYYFNRDGKSGSGDDDDKGRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22781 - DNA, 1392 bp, Artificial sequence
  L1rek polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggatgatgatgataaaggtcgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22782 - protein, 462 aa, Artificial sequence
  L2rekGG polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVGGDDDDKGGGRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22783 - DNA, 1389 bp, Artificial sequence
  L2rekGG polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgggtggtgatgacgacgataagggtggcggtcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22784 - protein, 465 aa, Artificial sequence
  L4rek#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKGDDDDKGEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22785 - DNA, 1398 bp, Artificial sequence
  L4rek#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaaggcgatgacgatgacaaaggtgagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22786 - protein, 462 aa, Artificial sequence
  L4rek#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETADDDDKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22787 - DNA, 1389 bp, Artificial sequence
  L4rek#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggtgagaccgccgatgacgatgacaaaagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22788 - protein, 462 aa, Artificial sequence
  L6rek polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKADDDDKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22789 - DNA, 1389 bp, Artificial sequence
  L6rek polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccgatgatgatgataaagccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22790 - protein, 463 aa, Artificial sequence
  L7rek#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDDDDKGQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22791 - DNA, 1392 bp, Artificial sequence
  L7rek#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatgatgatgataaaggtcaaccgtttgattatattggtttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22792 - protein, 464 aa, Artificial sequence
  L7rek#1b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQDDDDKGPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22793 - DNA, 1395 bp, Artificial sequence
  L7rek#1b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatcaagatgatgatgataaaggtccgtttgattatattggtttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22794 - protein, 461 aa, Artificial sequence
  L7rek#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGDDDDKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22795 - DNA, 1386 bp, Artificial sequence
  L7rek#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgatgatgatgataaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22796 - protein, 463 aa, Artificial sequence
  L7rek#2b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGDDDDKEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22797 - DNA, 1392 bp, Artificial sequence
  L7rek#2b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgatgatgatgataaagaaaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22798 - protein, 459 aa, Artificial sequence
  L8rek#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDDDDKGYKNYGYGEDGKHHETNLEAKYVVQSGPAKDLSFRIRQAWHRANADQGEGDQNEFRLIVDYPLSILGGHHHHHH

SEQ ID NO: 22799 - DNA, 1380 bp, Artificial sequence
  L8rek#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacgatgacgataaaggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22800 - protein, 461 aa, Artificial sequence
  L8rek#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGDDDDKGKHHETNLEAKYVVQSGPAKDLSFRIRQAWHRANADQGEGDQNEFRLIVDYPLSILGGHHHHHH

SEQ ID NO: 22801 - DNA, 1386 bp, Artificial sequence
  L8rek#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgatgatgatgataaaggcaaacaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22802 - protein, 464 aa, Artificial sequence
  L9rek polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGDDDDKGEGDQNEFRLIVDYPLSILGGHHHHHH

SEQ ID NO: 22803 - DNA, 1395 bp, Artificial sequence
  L9rek polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgatgatgatgataaaggcgaaggcgaccagaacgagttccgcctgatcgtcgactatccgctgtcgatcctgggcgggcatcaccatcaccatcactaa

SEQ ID NO: 22804 - protein, 464 aa, Artificial sequence
  BL7rek polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQGDDDDKSGPAKDLSFRIRQAWHRANADQGEGDQNEFRLIVDYPLSILGGHHHHHH

SEQ ID NO: 22805 - DNA, 1386 bp, Artificial sequence
  BL7rek polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacggcgatgatgatgataaatccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22806 - protein, 464 aa, Artificial sequence
  L7rek polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGDDDDKGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22807 - DNA, 1395 bp, Artificial sequence
  L7rek polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgatgatgatgataaaggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22808 - protein, 463 aa, Artificial sequence
  L3rek#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGDDDDKEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22809 - DNA, 1392 bp, Artificial sequence
  L3rek#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgatgatgatgataaagagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22810 - protein, 463 aa, Artificial sequence
  L3rek#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATDDDDKGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22811 - DNA, 1392 bp, Artificial sequence
  L3rek#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccgatgatgatgataaaggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22812 - protein, 463 aa, Artificial sequence
  L3rek#3 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAADDDDKGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22813 - DNA, 1392 bp, Artificial sequence
  L3rek#3 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctgatgatgatgataaaggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22814 - protein, 466 aa, Artificial sequence
  TL1mmp7turk polypeptide sequence
MVMSQKTLFTKSALAVAVALISTQAWSAGFHMFVSDQAEAKGFIEDSSLDLLLRNYYFNRDGKSGSGIVVLSLVMGRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22815 - DNA, 1401 bp, Artificial sequence
  TL1mmp7turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcgggattgttgttttatctttagttatgggtcgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22816 - protein, 465 aa, Artificial sequence
  L2mmp7turk polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVGGIVVLSLVMGGGRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22817 - DNA, 1398 bp, Artificial sequence
  L2mmp7turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgggtggtattgttgttttatctttagttatgggtggcggtcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22818 - protein, 468 aa, Artificial sequence
  L4mmp7turk polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKGIVVLSLVMGEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22819 - DNA, 1407 bp, Artificial sequence
  L4mmp7turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaaggcattgttgttttatctttagttatgggtgagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22820 - protein, 465 aa, Artificial sequence
  L4#2mmp7turk polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAIVVLSLVMSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22821 - DNA, 1398 bp, Artificial sequence
  L4#2mmp7turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggtgagaccgccattgttgttttatctttagttatgagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22822 - protein, 465 aa, Artificial sequence
  L6mmp7turk polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAIVVLSLVMAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22823 - DNA, 1398 bp, Artificial sequence
  L6mmp7turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccattgttgttttatctttagttatggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22824 - protein, 463 aa, Artificial sequence; identical to SEQ ID NO: 22790
  L7rek#1 polypeptide sequence

SEQ ID NO: 22825 - DNA, 1392 bp, Artificial sequence; identical to SEQ ID NO: 22791
  L7rek#1 polynucleotide sequence

SEQ ID NO: 22826 - protein, 466 aa, Artificial sequence
  L7mmp7turk#1b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGIVVLSLVMGQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22827 - DNA, 1401 bp, Artificial sequence
  L7mmp7turk#1b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcattgttgttttatctttagttatgggtcaaccgtttgattatattggtttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22828 - protein, 464 aa, Artificial sequence
  L7mmp7turk#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGIVVLSLVMSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22829 - DNA, 1395 bp, Artificial sequence
  L7mmp7turk#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcattgttgttttatctttagttatgtcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22830 - protein, 466 aa, Artificial sequence
  L7mmp7turk#2b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGIVVLSLVMEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22831 - DNA, 1401 bp, Artificial sequence
  L7mmp7turk#2b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcattgttgttttatctttagttatggaaaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22832 - protein, 462 aa, Artificial sequence
  L8mmp7turk#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSIVVLSLVMGYKNYGYGEDGKHHETNLEAKYVVQSGPAKDLSFRIRQAWHRANADQGEGDQNEFRLIVDYPLSILGGHHHHHH

SEQ ID NO: 22833 - DNA, 1389 bp, Artificial sequence
  L8mmp7turk#1 polypeptide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctattgttgttttatctttagttatgggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22834 - protein, 464 aa, Artificial sequence
  L8mmp7turk#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGIVVLSLVMGKHHETNLEAKYVVQSGPAKDLSFRIRQAWHRANADQGEGDQNEFRLIVDYPLSILGGHHHHHH

SEQ ID NO: 22835 - DNA, 1395 bp, Artificial sequence
  L8mmp7turk#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcattgttgttttatctttagttatgggcaaacaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22836 - protein, 463 aa, Artificial sequence; identical to SEQ ID NO: 13
  L8mmp7turk#3 polypeptide sequence

SEQ ID NO: 22837 - DNA, 1392 bp, Artificial sequence; identical to SEQ ID NO: 14
  L8mmp7turk#3 polynucleotide sequence

SEQ ID NO: 22838 - protein, 458 aa, Artificial sequence
  L8mmp7turk#3b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVAYSLTAGGEDGKHHETNLEAKYVVQSGPAKDLSFRIRQAWHRANADQGEGDQNEFRLIVDYPLSILGGHHHHHH

SEQ ID NO: 22839 - DNA, 1377 bp, Artificial sequence
  L8mmp7turk#3b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgttgcatatagcctgactgcgggtggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22840 - protein, 467 aa, Artificial sequence
  L9mmp7 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGIVVLSLVMGEGDQNEFRLIVDYPLSILGGHHHHHH

SEQ ID NO: 22841 - DNA, 1404 bp, Artificial sequence
  L9mmp7 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcattgttgttttatctttagttatgggcgaaggcgaccagaacgagttccgcctgatcgtcgactatccgctgtcgatcctgggcgggcatcaccatcaccatcactaa

SEQ ID NO: 22842 - protein, 464 aa, Artificial sequence
  BL7mmp7turk polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYGIVVLSLVMSGPAKDLSFRIRQAWHRANADQGEGDQNEFRLIVDYPLSILGGHHHHHH

SEQ ID NO: 22843 - DNA, 1395 bp, Artificial sequence
  BL7mmp7turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacggcattgttgttttatctttagttatgtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22844 - protein, 467 aa, Artificial sequence
  L7mmp7turk polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGIVVLSLVMGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22845 - DNA, 1404 bp, Artificial sequence
  L7mmp7turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcattgttgttttatctttagttatgggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22846 - protein, 466 aa, Artificial sequence
  L3mmp7turk#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGIVVLSLVMEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22847 - DNA, 1401 bp, Artificial sequence
  L3mmp7turk#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcattgttgttttatctttagttatggagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22848 - protein, 466 aa, Artificial sequence
  L3mmp7turk#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATIVVLSLVMGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22849 - DNA, 1401 bp, Artificial sequence
  L3mmp7turk#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccattgttgttttatctttagttatgggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22850 - protein, 466 aa, Artificial sequence
  L3mmp7turk#3 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAIVVLSLVMGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22851 - DNA, 1401 bp, Artificial sequence
  L3mmp7turk#3 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctattgttgttttatctttagttatgggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22852 - protein, 463 aa, Artificial sequence
  L3mmp7turk # 4 polypeptide sequence
MRYIRQLCCVSLLCLSGSAAAANVRLQHHHHHHHENLYFQGLEDAFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAALVVLSLTQGATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSIL

SEQ ID NO: 22853 - DNA, 1392 bp, Artificial sequence
  L3mmp7turk # 4 polynucleotide sequence
atgcgctatatccgacagttatgctgtgtaagcttactctgcttaagcggatctgccgccgccgcgaacgtccgtctacagcaccatcaccatcaccatcacgaaaatttatattttcaaggtctcgaggacgcattcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctcttgtggtgctgagtctgacccagggtgcgaccggcttccagctgcagagcagcgaattcgaagggctcgacctagaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgtaa

SEQ ID NO: 22854 - protein, 458 aa, Artificial sequence
  L3mmp7turk # 4b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAALVVLSLTQGATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22855 - DNA, 1377 bp, Artificial sequence
  L3mmp7turk # 4b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctcttgtggtgctgagtctgacccagggtgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22856 - protein, 6 aa, Artificial sequence
  MMP7 Cleavage site polypeptide sequence
ELAELR

SEQ ID NO: 22857 - DNA, 18 bp, Artificial sequence
  MMP7 Cleavage site polynucleotide sequence
gaacttgctgaattaaga

SEQ ID NO: 22858 - protein, 464 aa, Artificial sequence
  L1vargo polypeptide sequence
MVMSQKTLFTKSALAVAVALISTQAWSAGFHMFVSDQAEAKGFIEDSSLDLLLRNYYFNRDGKSGSGELAELRGRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22859 - DNA, 1395 bp, Artificial sequence
  L1vargo polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaacttgctgaattaagaggtcgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22860 - protein, 463 aa, Artificial sequence
  L2mmp7vargo polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVGGELAELRGGGRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22861 - DNA, 1392 bp, Artificial sequence
  L2mmp7vargo polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgggtggtgaacttgctgaattaagaggtggcggtcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22862 - protein, 466 aa, Artificial sequence
  L4mmp7vargo#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKGELAELRGEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22863 - DNA, 1401 bp, Artificial sequence
  L4mmp7vargo#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaaggcgaacttgctgaattaagaggtgagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22864 - protein, 463 aa, Artificial sequence
  L4rek#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAELAELRSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22865 - DNA, 1392 bp, Artificial sequence
  L4rek#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggtgagaccgccgaacttgctgaattaagaagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22866 - protein, 463 aa, Artificial sequence
  L6mmp7vargo polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAELAELRAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22867 - DNA, 1392 bp, Artificial sequence
  L6mmp7vargo polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccgaacttgctgaattaagagccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22868 - protein, 464 aa, Artificial sequence
  L7mmp7vargo#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGELAELRGQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22869 - DNA, 1395 bp, Artificial sequence
  L7mmp7vargo#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgaacttgctgaattaagaggtcaaccgtttgattatattggtttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22870 - protein, 465 aa, Artificial sequence
  L7rek#1b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQELAELRGPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22871 - DNA, 1398 bp, Artificial sequence
  L7rek#1b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatcaagaacttgctgaattaagaggtccgtttgattatattggtttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22872 - protein, 462 aa, Artificial sequence
  L7mmp7vargo#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGELAELRSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22873 - DNA, 1389 bp, Artificial sequence
  L7mmp7vargo#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgaacttgctgaattaagatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22874 - protein, 464 aa, Artificial sequence
  L7mmp7vargo#2b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGELAELREKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22875 - DNA, 1395 bp, Artificial sequence
  L7mmp7vargo#2b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgaacttgctgaattaagagaaaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22876 - protein, 460 aa, Artificial sequence
  L8mmp7vargo#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSELAELRGYKNYGYGEDGKHHETNLEAKYVVQSGPAKDLSFRIRQAWHRANADQGEGDQNEFRLIVDYPLSILGGHHHHHH

SEQ ID NO: 22877 - DNA, 1383 bp, Artificial sequence
  L8mmp7vargo#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgaacttgctgaattaagaggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22878 - protein, 462 aa, Artificial sequence
  L8mmmp7vargo#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGELAELRGKHHETNLEAKYVVQSGPAKDLSFRIRQAWHRANADQGEGDQNEFRLIVDYPLSILGGHHHHHH

SEQ ID NO: 22879 - DNA, 1389 bp, Artificial sequence
  L8mmmp7vargo#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaacttgctgaattaagaggcaaacaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22880 - protein, 465 aa, Artificial sequence
  L9mmp7vargo polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGELAELRGEGDQNEFRLIVDYPLSILGGHHHHHH

SEQ ID NO: 22881 - DNA, 1398 bp, Artificial sequence
  L9mmp7vargo polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaacttgctgaattaagaggcgaaggcgaccagaacgagttccgcctgatcgtcgactatccgctgtcgatcctgggcgggcatcaccatcaccatcactaa

SEQ ID NO: 22882 - protein, 462 aa, Artificial sequence
  BL7mmp7vagro polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYGELAELRSGPAKDLSFRIRQAWHRANADQGEGDQNEFRLIVDYPLSILGGHHHHHH

SEQ ID NO: 22883 - DNA, 1389 bp, Artificial sequence
  BL7mmp7vagro polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacggcgaacttgctgaattaagatccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22884 - protein, 465 aa, Artificial sequence
  L7mmp7vargo polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGELAELRGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22885 - DNA, 1398 bp, Artificial sequence
  L7mmp7vargo polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgaacttgctgaattaagaggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22886 - protein, 464 aa, Artificial sequence
  L3mmp7vargo#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGELAELREMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22887 - DNA, 1395 bp, Artificial sequence
  L3mmp7vargo#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgaacttgctgaattaagagagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22888 - protein, 464 aa, Artificial sequence
  L3mmp7vargo#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATELAELRGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22889 - DNA, 1395 bp, Artificial sequence
  L3mmp7vargo#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccgaacttgctgaattaagaggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22890 - protein, 464 aa, Artificial sequence
  L3mmp7vargo#3 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAELAELRGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22891 - DNA, 1395 bp, Artificial sequence
  L3mmp7vargo#3 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctgaacttgctgaattaagaggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22892 - protein, 8 aa, Artificial sequence
  MMP2 cleavage site polypeptide sequence
DIVVSLRS

SEQ ID NO: 22893 - DNA, 24 bp, Artificial sequence
  MMP2 cleavage site polynucleotide sequence
gatattgttgtttctttacgttct

SEQ ID NO: 22894 - protein, 466 aa, Artificial sequence
  L1mmp2turk polypeptide sequence
MVMSQKTLFTKSALAVAVALISTQAWSAGFHMFVSDQAEAKGFIEDSSLDLLLRNYYFNRDGKSGSGDIVVSLRSGRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22895 - DNA, 1401 bp, Artificial sequence
  L1mmp2turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggatattgttgtttctttacgttctggtcgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22896 - protein, 465 aa, Artificial sequence
  L2mmp2turk polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVGGDIVVSLRSGGGRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22897 - DNA, 1398 bp, Artificial sequence
  L2mmp2turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgggtggtgatattgttgtttctttacgttctggtggcggtcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22898 - protein, 468 aa, Artificial sequence
  L4rmmp2turk#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKGDIVVSLRSGEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22899 - DNA, 1407 bp, Artificial sequence
  L4rmmp2turk#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaaggcgatattgttgtttctttacgttctggtgagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22900 - protein, 465 aa, Artificial sequence
  L4mmp2turk#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETADIVVSLRSSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22901 - DNA, 1398 bp, Artificial sequence
  L4mmp2turk#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggtgagaccgccgatattgttgtttctttacgttctagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22902 - protein, 465 aa, Artificial sequence
  L6mmp2turk polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKADIVVSLRSAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22903 - DNA, 1398 bp, Artificial sequence
  L6mmp2turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccgatattgttgtttctttacgttctgccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22904 - protein, 466 aa, Artificial sequence
  L7mmp2turk#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDIVVSLRSGQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22905 - DNA, 1401 bp, Artificial sequence
  L7mmp2turk#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatattgttgtttctttacgttctggtcaaccgtttgattatattggtttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22906 - protein, 467 aa, Artificial sequence
  L7mmp2turk#1b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQDIVVSLRSGPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22907 - DNA, 1404 bp, Artificial sequence
  L7mmp2turk#1b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatcaagatattgttgtttctttacgttctggtccgtttgattatattggtttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22908 - protein, 464 aa, Artificial sequence
  L7mmp2turk#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGDIVVSLRSSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22909 - DNA, 1395 bp, Artificial sequence
  L7mmp2turk#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgatattgttgtttctttacgttcttcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22910 - protein, 466 aa, Artificial sequence
  L7mmp2turk#2b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGDIVVSLRSEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22911 - DNA, 1401 bp, Artificial sequence
  L7mmp2turk#2b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgatattgttgtttctttacgttctgaaaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22912 - protein, 462 aa, Artificial sequence
  L8mmp2turk#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDIVVSLRSGYKNYGYGEDGKHHETNLEAKYVVQSGPAKDLSFRIRQAWHRANADQGEGDQNEFRLIVDYPLSILGGHHHHHH

SEQ ID NO: 22913 - DNA, 1389 bp, Artificial sequence
  L8mmp2turk#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgatattgttgtttctttacgttctggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22914 - protein, 464 aa, Artificial sequence
  L8mmp2turk#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGDIVVSLRSGKHHETNLEAKYVVQSGPAKDLSFRIRQAWHRANADQGEGDQNEFRLIVDYPLSILGGHHHHHH

SEQ ID NO: 22915 - DNA, 1395 bp, Artificial sequence
  L8mmp2turk#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgatattgttgtttctttacgttctggcaaacaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22916 - protein, 467 aa, Artificial sequence
  L9mmp2turk polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGDIVVSLRSGEGDQNEFRLIVDYPLSILGGHHHHHH

SEQ ID NO: 22917 - DNA, 1404 bp, Artificial sequence
  L9mmp2turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgatattgttgtttctttacgttctggcgaaggcgaccagaacgagttccgcctgatcgtcgactatccgctgtcgatcctgggcgggcatcaccatcaccatcactaa

SEQ ID NO: 22918 - protein, 464 aa, Artificial sequence
  BL7mmp2turk polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYGDIVVSLRSSGPAKDLSFRIRQAWHRANADQGEGDQNEFRLIVDYPLSILGGHHHHHH

SEQ ID NO: 22919 - DNA, 1395 bp, Artificial sequence
  BL7mmp2turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacggcgatattgttgtttctttacgttcttccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22920 - protein, 467 aa, Artificial sequence
  L7mmp2turk polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGDIVVSLRSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22921 - DNA, 1404 bp, Artificial sequence
  L7mmp2turk polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgatattgttgtttctttacgttctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22922 - protein, 466 aa, Artificial sequence
  L3mmp2turk#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGDIVVSLRSEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22923 - DNA, 1401 bp, Artificial sequence
  L3mmp2turk#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgatattgttgtttctttacgttctgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22924 - protein, 466 aa, Artificial sequence
  L3mmp2turk#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATDIVVSLRSGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22925 - DNA, 1401 bp, Artificial sequence
  L3mmp2turk#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccgatattgttgtttctttacgttctggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22926 - protein, 466 aa, Artificial sequence
  L3mmp2turk#3 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAADIVVSLRSGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22927 - DNA, 1401 bp, Artificial sequence
  L3mmp2turk#3 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctgatattgttgtttctttacgttctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22928 - protein, 8 aa, Artificial sequence
  mmp9 cleavage site polypeptide sequence
VVPLSLRS

SEQ ID NO: 22929 - DNA, 24 bp, Artificial sequence
  mmp9 cleavage site polynucleotide sequence
gttgttcctttaagtttaagatct

SEQ ID NO: 22930 - protein, 466 aa, Artificial sequence
  L1mmp-9 polypeptide sequence
MVMSQKTLFTKSALAVAVALISTQAWSAGFHMFVSDQAEAKGFIEDSSLDLLLRNYYFNRDGKSGSGVVPLSLRSGRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22931 - DNA, 1401 bp, Artificial sequence
  L1mmp-9 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggttgttcctttaagtttaagatctggtcgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22932 - protein, 462 aa, Artificial sequence; identical to SEQ ID NO: 22782
  L2-mmp9GG polypeptide sequence

SEQ ID NO: 22933 - DNA, 1398 bp, Artificial sequence
  L2-mmp9GG polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgggtggtgttgttcctttaagtttaagatctggtggcggtcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22934 - protein, 468 aa, Artificial sequence
  L4-mmp9#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKGVVPLSLRSGEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22935 - DNA, 1407 bp, Artificial sequence
  L4-mmp9#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaaggcgttgttcctttaagtttaagatctggtgagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22936 - protein, 462 aa, Artificial sequence; identical to SEQ ID NO: 22786
  L4-mmp9#2 polypeptide sequence

SEQ ID NO: 22937 - DNA, 1398 bp, Artificial sequence
  L4-mmp9#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggtgagaccgccgttgttcctttaagtttaagatctagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22938 - protein, 465 aa, Artificial sequence
  L6-mmp9 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAVVPLSLRSAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22939 - DNA, 1398 bp, Artificial sequence
  L6-mmp9 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccgttgttcctttaagtttaagatctgccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22940 - protein, 466 aa, Artificial sequence
  L7-mmp9#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGVVPLSLRSGQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22941 - DNA, 1401 bp, Artificial sequence
  L7-mmp9#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgttgttcctttaagtttaagatctggtcaaccgtttgattatattggtttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22942 - protein, 467 aa, Artificial sequence
  L7-mmp9#1b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQVVPLSLRSGPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22943 - DNA, 1404 bp, Artificial sequence
  L7-mmp9#1b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatcaagttgttcctttaagtttaagatctggtccgtttgattatattggtttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22944 - protein, 464 aa, Artificial sequence
  L7rek#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGVVPLSLRSSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22945 - DNA, 1395 bp, Artificial sequence
  L7rek#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgttgttcctttaagtttaagatcttcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22946 - protein, 466 aa, Artificial sequence
  L7-mmp9#2b polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGVVPLSLRSEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22947 - DNA, 1401 bp, Artificial sequence
  L7-mmp9#2b polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgttgttcctttaagtttaagatctgaaaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22948 - protein, 462 aa, Artificial sequence
  L8-mmp9#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSVVPLSLRSGYKNYGYGEDGKHHETNLEAKYVVQSGPAKDLSFRIRQAWHRANADQGEGDQNEFRLIVDYPLSILGGHHHHHH

SEQ ID NO: 22949 - DNA, 1389 bp, Artificial sequence
  L8-mmp9#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgttgttcctttaagtttaagatctggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22950 - protein, 464 aa, Artificial sequence
  L8-mmp9#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGVVPLSLRSGKHHETNLEAKYVVQSGPAKDLSFRIRQAWHRANADQGEGDQNEFRLIVDYPLSILGGHHHHHH

SEQ ID NO: 22951 - DNA, 1395 bp, Artificial sequence
  L8-mmp9#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgttgttcctttaagtttaagatctggcaaacaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22952 - protein, 467 aa, Artificial sequence
  L9-mmp9 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGVVPLSLRSGEGDQNEFRLIVDYPLSILGGHHHHHH

SEQ ID NO: 22953 - DNA, 1404 bp, Artificial sequence
  L9-mmp9 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgttgttcctttaagtttaagatctggcgaaggcgaccagaacgagttccgcctgatcgtcgactatccgctgtcgatcctgggcgggcatcaccatcaccatcactaa

SEQ ID NO: 22954 - protein, 467 aa, Artificial sequence
  BL7-mmp9 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQGVVPLSLRSSGPAKDLSFRIRQAWHRANADQGEGDQNEFRLIVDYPLSILGGHHHHHH

SEQ ID NO: 22955 - DNA, 1395 bp, Artificial sequence
  BL7-mmp9 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacggcgttgttcctttaagtttaagatcttccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22956 - protein, 467 aa, Artificial sequence
  L7-mmp9 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGVVPLSLRSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22957 - DNA, 1404 bp, Artificial sequence
  L7-mmp9 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgttgttcctttaagtttaagatctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22958 - protein, 466 aa, Artificial sequence
  L3-mmp9#1 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGVVPLSLRSEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22959 - DNA, 1401 bp, Artificial sequence
  L3-mmp9#1 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgttgttcctttaagtttaagatctgagatgcaaccgaccgccccggtcttcgccgctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22960 - protein, 466 aa, Artificial sequence
  L3-mmp9#2 polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATVVPLSLRSGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22961 - DNA, 1401 bp, Artificial sequence
  L3-mmp9#2 polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctggcggcagccgcctgttcccgcagaccgcgaccgttgttcctttaagtttaagatctggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22962 - protein, 466 aa, Artificial sequence
  L3-mmp9#3  polypeptide sequence
MVMSQKTLFTKSALAVAVALISTQAWSAGFHMFVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAVVPLSLRSGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSILGGHHHHHH

SEQ ID NO: 22963 - DNA, 1401 bp, Artificial sequence
  L3-mmp9#3  polynucleotide sequence
atggtcatgagccagaaaaccctgtttacaaagtctgctctcgcagtcgcagtggcgcttatctccacccaggcctggtcggcaggctttcatatgttcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctgggcctgaagctcgacggcacctccgacaagaccggcaccggcaacctgccggtgatgaacgacggcaagccgcgcgatgactacagccgcgccggcggcgccgtgaaggtgcgcatctccaagaccatgctgaagtggggcgagatgcaaccgaccgccccggtcttcgccgctgttgttcctttaagtttaagatctggcggcagccgcctgttcccgcagaccgcgaccggcttccagctgcagagcagcgaattcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccacggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggatggcaagcaccacgaaaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgggcgggcatcaccatcaccatcactaa

SEQ ID NO: 22964 - protein, 441 aa, Pseudomonas aeruginosa; identical to SEQ ID NO: 3878

SEQ ID NO: 22965 - protein, 439 aa, Pseudomonas putida; identical to SEQ ID NO: 15345

SEQ ID NO: 22966 - protein, 439 aa, Pseudomonas putida; identical to SEQ ID NO: 15345

SEQ ID NO: 22967 - protein, 433 aa, Pseudomonas fluorescens
MLKQRMSLIALGILSASTAMANDQDQSKGFIEDSHLNIAARNAYISRDYKNGKQDKAEWGQGFIGKLESGFTQGTVGVGVDVIGQYAIRLDGGKGRAGAGGIDFFKPGNGTTDNPGSAPHDLVKGGAAVKFRVSNTVLKYGDQFPAVPVLQYDNSRLLSETYTGTSIVSKEIAGLQLDAGHFTKEARKSAEGTDSGRLKSIDYIGGSYKFTESLSAALYASDMQDVLKKQYVNVNYVLALPEKQSLTFDFNGYKTKLDRSFALENQKDADARDNKIWSLGATWAVGPHSFTVAHQRSTGDTGYLYGGYRNAGGIGDGGNTILLANSYWSDFNGKDERSWQLGYGIDFATFGVPGLTYNVAYVRGTNIDDGTNRGDGSEREIWNQFKYVVQSGPAKDLSLRARASWLRVSNNADQYNVGGNEIRLFADYPINVF

SEQ ID NO: 22968 - protein, 422 aa, Klebsiella pneumoniae
MKKELPLIALGIIAAAPAFASQQSTSQGFIEDSHLDLFLRNAYIKRDYRDGLPDKAEWGQGIIATFESGFTQGPVGFGVDGIAQYAVRLDGGRGRSGAGGIDFFAQDDDGRAKSDLAKFGATAKMRFSNTVLSYGSQRPMLPIVYADDSRLLYESYTGTMLTSREIDGLEINAGYLTDQQRKSDDSHNSGLKSLTFGGASYQFNDQLSGALYASHVEDVLNKQYLGLNYKQPFAADQQLIVDFNGYNSRLNQEYADANGTGRSNSIWSLAASYIWDIHTFKVAYQQSSGSTGYHYGGYQNQGGVGDGGNTIWLANSYWSDFNGEDERSWQASYGLDFAGLGVPGLSWTTAYVRGDNIKTAETSNGKEHEWFNQVQYQVQNGMAKDLKLRLRYSVLRVSSNASDYNVSGNEVRFYVEYPFNVF

SEQ ID NO: 22969 - protein, 435 aa, Pseudomonas aeruginosa
MIRVRPVGRLALFLALGGTSPCHAATEEAKAPDYLEWRLLNRNYFLYNDYRRADAGRGYRKEWAHGLIADLESAYTPGRVGFGLDLHGFAGFKLDGGRGHAGTGLLPLDSSGDNASEYSDAGAALKLRLGESLLKVGEMTVETPVFDTSDKRLQPQYARGFFLQSDDLDRVRIQAGRFTAFKEQASSSGHGDFDGYGASTAGSAIGFAGASLAASDNLSGSLFAAQLDNVWRQVYLNMNLQRAAFSLDGNLYRTRDQGRSRAGAIDTLAYSLQLKYRVGAQGFSLAYQRVHGDTPFDFVGGDSIYLANSIKYADFNGPGERSWQARYDLDLAPFGLPGLSFMARYVSGRAIDGSHAPAGGAYNPLGADGRYRTLQGSGGKHWERDLDLRYLFASGPLKDLSLNVSHLSHRANAAQAGDDIDRLYLIVEYPLKGSL

SEQ ID NO: 22970 - protein, 435 aa, Pseudomonas aeruginosa
MIRVRPVGRLALFLALGGTSPCHAATEEAKAPDYLEWRLLNRNYFLYNDYRRADAGRGYRKEWAHGLIADLESAYTPGRVGFGLDLHGFAGFKLDGGRGHAGTGLLPLDSSGDNASEYSDAGAALKLRLGESLLKVGEMTVETPVFDTSDKRLQPQYARGFFLQSDDLDRVRIQAGRFTAFKEQASSSGHGDFDGYGASTAGSAIGFAGASLAASDNLSGSLFAAQLDNVWRQVYLNMNLQRAAFSLDGNLYRTRDQGRSRAGAIDTLAYSLQLKYRVGAQGFSLAYQRVHGDTPFDFVGGDSIYLANSIKYADFNGPGERSWQARYDLDLAPFGLPGLSFMARYVSGRAIDGSHAPAGGAYNPLGADGRYRPLQGSGGKHWERDLDLRYVFASGPLKDLSLNVSHLSHRANAAQAGDDIDRLYLIVEYPLKGSL

SEQ ID NO: 22971 - protein, 444 aa, Pseudomonas aeruginosa; identical to SEQ ID NO: 22044

SEQ ID NO: 22972 - protein, 96 aa, Pseudomonas aeruginosa
MRNLFALTPMALALCTASAAWADEGEAKEGFIEGSSLQLLTRNYYFNHDRRHASGHDSKEWAQGFIATFQSGYTPGVVGFGVDAYGMLGLKLDGGG

SEQ ID NO: 22973 - protein, 448 aa, Pseudomonas aeruginosa; identical to SEQ ID NO: 13884

SEQ ID NO: 22974 - protein, 448 aa, Pseudomonas aeruginosa; identical to SEQ ID NO: 13884

SEQ ID NO: 22975 - protein, 484 aa, Pseudomonas aeruginosa; identical to SEQ ID NO: 2509

SEQ ID NO: 22976 - protein, 409 aa, Pseudomonas aeruginosa
MHPTPRLAAALLAGSGLGWPLLAQADLVEDSHASLELRNFYFNRDFRQSGARDNADEWAQGFLLRLESGFSEGTVGFGVDAIGLLGFKLDSGGGSGGTGLLPADGSAGGSQDDYAKLGLTAKARVSNSLLKVGALHFKSPLVSANDTRLLPELFRGALLDVQEIDGLTLRGAHLDRNKLNSSSDYQVFSANRIGGRSDAFDFAGGDYRLTPALTASLHQGRLRDIYRQTFAGLVHTLDLGGQRSLKSDLRFARASEDGGFRELDNRAFGALFSLRLGAHAVAAGYQRISGDDPYPYIAGSDPYLVNFIQIGDFGNVDERSWQLRYDYDFGALGLPGLSFMSRYVSGDNVARGAANDGKEWERNTDLGYVVQSGPLKNLGVKWRNATVRSNFANDLDENRLILSYSLTLW

SEQ ID NO: 22977 - protein, 427 aa, Pseudomonas aeruginosa
MSTSLPQAARSVRSSRSTTLTTTAVVLASIAPLGNAAGFLEDSKASLETRNFYMNRDFRDGPGQSKREEWAQGFILNLQSGYTQGTVGFGLDAMGMLGVKLDSGRGRSGTGLLPKDSDGRAPDTYSKLGLTAKVKVSQSELKVGTLIPKLPSVQPNNGRIFPQIFEGALLTSKEIKDLGFTAGRLEKTKIRDSSDSEDLALNDKNGRFAGVSADHFDLGGLDYKLTDQLTASYHYSNLQDVYRQHFVGLLHSWPIGPGELTSDLRFARSTDSGSAKAGGIDNKSLNGMFTYSLGNHAFGAAWQRMNGDDAFPYLEGSNPYLVNFVQVNDFAGPKERSWQLRYDYDFVGLGIPGLTFMTRYVKGDNVELAGQRGEGREWERNTELQYVFQSGALKNLGIRWRNATFRSNFTRDIDENRLIVSYTLPIW

SEQ ID NO: 22978 - protein, 414 aa, Pseudomonas aeruginosa 39016
MSRSTTLTTTAVVLAGIAPLGNAAGFLEDSKASLETRNFYMNRDFRDGPGQSKREEWAQGFILNLQSGYTQGTVGFGLDAMGMLGVKLDSGRGRSGTGLLPKDSDGRAPDTYSKLGLTAKVKVSQSELKVGTLIPKLPSVQPNNGRIFPQIFEGALLTSKEIKDLGFTAGRLEKTKIRDSSDSEDLALNDKNGRFAGVSADHFDLGGLDYKLTDQLTASYHYSNLQDVYRQHFVGLLHSWPIGPGELTSDLRFARSTDSGSAKAGGIDNKSLNGMFTYSLGNHAFGAAWQRMNGDDAFPYLEGSNPYLVNFVQVNDFAGPKERSWQLRYDYDFVGLGIPGLTFMTRYVKGDNVELAGQSGEGREWERNTELQYVFQSGALKNLGVRWRNATFRSNFTRDIDENRLIVSYTLPIW

SEQ ID NO: 22979 - protein, 431 aa, Pseudomonas stutzeri; identical to SEQ ID NO: 531

SEQ ID NO: 22980 - protein, 417 aa, Pseudomonas aeruginosa
MKIRRKTAVPRNAGAVLPMLACLAAQAAEGGFLEEAKTDLVLRNYYFNRDFRDHDAGKSLVDEWAQGFILKFSSGYTPGTVGVGLDAIGLFGVKLNSGRGTSNSELLPLHDDGRAADNYGRVGVAAKLRVSASELKIGEMLPDIPLLRYDDGRLLPQTFRGFAVVSRELPGLALQAGRFDAVSLRNSADMQDLSAWSAPTQKSDGFNYAGAEYRFNRERTQLGLWHGQLEDVYRQSYANLLHKQRVGDWTLGANLGLFVDRDDGAARAGEIDSHTLYGLFSAGIGLHTFYLGLQKVGGDSGWQSVYGSSGRSMGNDMFNGNFTNADERSWQVRYDYDFVGLGWPGLIGMVRYGHGSNATTKAGSGGKEWERDVELGYTVQSGPLARLNVRLNHASNRRSFNSDFDQTRLVVSYPLSW

SEQ ID NO: 22981 - protein, 421 aa, Pseudomonas aeruginosa; identical to SEQ ID NO: 13902

SEQ ID NO: 22982 - protein, 15 aa, Artificial sequence
  BL9 Loop sequence
KYVVQSGPAKDLSFR

SEQ ID NO: 22983 - protein, 30 aa, Artificial sequence
  FadL signal peptide
MVMSQKTLFTKSALAVAVALISTQAWSAGF

SEQ ID NO: 22984 - protein, 418 aa, Artificial sequence
  L1 peptide sequence
FVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGRNGSGAGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQGEGDQNEFRLIVDYPLSIL

SEQ ID NO: 22985 - protein, 347 aa, Artificial sequence
  L1 peptide sequence
FVSDQAEAKGFIEDSSLDLLLRNYYFNRDGKSGSGDRVDWTQGFLTTYESGFTQGTVGFGVDAFGYLGLKLDGTSDKTGTGNLPVMNDGKPRDDYSRAGGAVKVRISKTMLKWGEMTATGFQLQSSEFEGLDLEAGHFTEGKEPTTVKSRGSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFNGPGEKSWQARYDLNLASYGVPGLTFMVRYINGKDIDGTKEDGKHHETNLEAKYVVQSGPAKDLSFRIRQAWHRANADQGEGDQNEFRLIVDYPLSIL

SEQ ID NO: 22986 - protein, 466 aa, Artificial sequence; identical to SEQ ID NO: 22826
  L7mmp7turkrek#1 polypeptide sequence

SEQ ID NO: 22987 - DNA, 1401 bp, Artificial sequence; identical to SEQ ID NO: 22827
  L7mmp7turkrek#1 polynucleotide sequence

SEQ ID NO: 22988 - protein, 15 aa, Artificial sequence
  L1 Loop sequence
NRDGKSGSGDRVDWT

SEQ ID NO: 22989 - protein, 28 aa, Artificial sequence
  L2 Loop sequence
KLDGTSDKTGTGNLPVMNDGKPRDDYSR

SEQ ID NO: 22990 - protein, 29 aa, Artificial sequence
  L3 Loop sequence
LKWGEMQPTAPVFAAGGSRLFPQTATGFQ

SEQ ID NO: 22991 - protein, 32 aa, Artificial sequence
  L4 Loop sequence
GHFTEGKEPTTVKSRGELYATYAGETAKSADF

SEQ ID NO: 22992 - protein, 9 aa, Artificial sequence
  L5 Loop sequence
AELEDIYRQ

SEQ ID NO: 22993 - protein, 16 aa, Artificial sequence
  L6 Loop sequence
RTNDEGKAKAGDISNT

SEQ ID NO: 22994 - protein, 42 aa, Artificial sequence
  L7 Loop sequence
KVHGDQPFDYIGFGRNGSGAGGDSIFLANSVQYSDFNGPGEK

SEQ ID NO: 22995 - protein, 30 aa, Artificial sequence
  L8 Loop sequence
NGKDIDGTKMSDNNVGYKNYGYGEDGKHHE

SEQ ID NO: 22996 - protein, 14 aa, Artificial sequence
  L9 Loop sequence
HRANADQGEGDQNE

SEQ ID NO: 22997 - protein, 18 aa, Artificial sequence
  BL1 Loop sequence
FVSDQAEAKGFIEDSSLD

SEQ ID NO: 22998 - protein, 14 aa, Artificial sequence
  BL2 Loop sequence
TYESGFTQGTVGFG

SEQ ID NO: 22999 - protein, 8 aa, Artificial sequence
  LB3 Loop sequence
VRISKTML

SEQ ID NO: 23000 - protein, 11 aa, Artificial sequence
  BL4 Loop sequence
LQSSEFEGLDL

SEQ ID NO: 23001 - protein, 9 aa, Artificial sequence
  BL5 Loop sequence
YAITDNLSA

SEQ ID NO: 23002 - protein, 9 aa, Artificial sequence
  BL6 Loop sequence
IPLASDQSL

SEQ ID NO: 23003 - protein, 8 aa, Artificial sequence
  BL7 Loop sequence
YTLDAHTF

SEQ ID NO: 23004 - protein, 15 aa, Artificial sequence
  BL8 Loop sequence
DLNLASYGVPGLLTF
